United States Patent
Dijkhuizen et al.

(10) Patent No.: US 10,808,271 B2
(45) Date of Patent: Oct. 20, 2020

(54) ALPHA GLUCANS

(71) Applicant: NESTEC S.A., Vevey (CH)

(72) Inventors: Lubbert Dijkhuizen, AG Groningen (NL); Joana Gangoiti Munecas, AG Groningen (NL); Sander Sebastiaan Van Leeuwen, AG Groningen (NL); Christina Vafeiadi, Lausanne (CH); Stephane Duboux, St-Prex (CH)

(73) Assignee: Societe des Produits Nestle S.A., Vevey (CH)

( * ) Notice: Subject to any disclaimer, the term of this patent is extended or adjusted under 35 U.S.C. 154(b) by 0 days.

(21) Appl. No.: 16/305,272

(22) PCT Filed: May 31, 2017

(86) PCT No.: PCT/EP2017/063214
§ 371 (c)(1),
(2) Date: Nov. 28, 2018

(87) PCT Pub. No.: WO2017/207663
PCT Pub. Date: Dec. 7, 2017

(65) Prior Publication Data
US 2019/0330671 A1    Oct. 31, 2019

(30) Foreign Application Priority Data
Jun. 2, 2016  (EP) .................................... 16172606

(51) Int. Cl.
| | |
|---|---|
| C12P 19/18 | (2006.01) |
| C12N 9/26 | (2006.01) |
| C12N 9/44 | (2006.01) |
| C12P 19/00 | (2006.01) |
| A23L 33/21 | (2016.01) |
| A23K 20/189 | (2016.01) |
| C12P 19/04 | (2006.01) |

(52) U.S. Cl.
CPC ............... *C12P 19/18* (2013.01); *A23L 33/21* (2016.08); *A23K 20/189* (2016.05); *C12P 19/04* (2013.01)

(58) Field of Classification Search
CPC ........ C12N 9/2428; C12P 19/04; C12P 19/02; C12P 19/14; C12Y 204/00; C12Y 302/01039
USPC ......... 435/101, 102, 193, 201, 152.2, 252.5, 435/205
See application file for complete search history.

(56) References Cited

FOREIGN PATENT DOCUMENTS

EP    2248907    11/2010

OTHER PUBLICATIONS

Davos et al., Proteins: Structure, Function and Genetics, 2000, vol. 41: 98-107.*
Wristlock et al., Quarterly Reviews of Biophysics 2003, vol. 36 (3): 307-340.*
Kwiatkowski et al., Biochemistry 38:11643-11650, 1999.*
Kisselev L., Structure, 2002, vol. 10: 8-9.*
Meng et al. "Structure-function relationships of family GH70 glucansucrase and 4,6-alpha-glucanotransferase enzymes, and their evolutionary relationships with family GH13 enzymes" Cellular and Molecular Life Sciences, 2016, vol. 73, pp. 2681-2706.
Vuillemin et al. "Characterization of the first alpha-(1-3) branching sucrases of GH70 family" Journal of Biological Chemistry Jan. 13, 2016, vol. 291, No. 14, pp. 7687-7702, XP055320418.
Kralj et al. "Glucan synthesis in the genus *Lactobacillus*: isolation and characterization of glucansucrase genes, enzymes and glucan products from six different strains" Microbiology, 2004, vol. 150, pp. 3681-3690.
Barretto et al. "Genome Sequence of *Lactobacillus fermentum* Strain NCC2970" Genome Announcements, Nov./Dec. 2016, vol. 4, issue 6, e01254-16.
Meng et al. "Synthesis of New Hyperbranched alpha-Glucans from Sucrose by *Lactobacillus reuteri* 180 Glucansucrase Mutants" Journal of Agricultural and Food Chemistry, 2016, vol. 64, pp. 433-442.
Leemhuis et al. "Glucansucrases: Three-dimensional structures, reactions, mechanism, alpha-glucan analysis and their implications in biotechnology and food applications" Journal of Biotechnology, 2013, vol. 163, pp. 250-272.
Irague et al. "Structure and Property Engineering of alpha-D-Glucans Synthesized by Dextransucrase Mutants" Biomacromolecules, 2012, vol. 13, pp. 187-195.
Woranovicz-Barreira et al. "Chemotyping glucans from lichens of the genus *Cladonia*" Phytochemistry, 1999, vol. 52, pp. 1069-1074.
Carbonero et al. "Polysaccharides of lichenized fungi of three *Cladina* spp.: significance as chemotypes" Phytochemistry, 2002, vol. 61, pp. 681-686.

\* cited by examiner

*Primary Examiner* — Robert B Mondesi
*Assistant Examiner* — Mohammad Y Meah
(74) *Attorney, Agent, or Firm* — K&L Gates LLP

(57) ABSTRACT

The present invention relates to the field of poly- and oligosaccharides and their dietary effects. In particular it relates to a method of producing an α-glucan containing (α1→3) linked D-glucose units. The invention also provides a branched α-glucan comprising alternating (α1→4) and (α1→3) glucosidic linkages and having (α1→3,4) branching points, a food composition, and the use of an α-glucanotransferase enzyme for reducing the digestible carbohydrates of a starch containing food material. Further aspects of the invention are a bacteria, an enzyme and an expression vector.

11 Claims, 10 Drawing Sheets
Specification includes a Sequence Listing.

Figure 2

| Bacterial strain | NCBI accession numbers | Specificity | Motif II | Motif III | Motif IV | Motif I |
|---|---|---|---|---|---|---|
| | | | 3  4 | 5 | 67 | 1  2 |
| A | | | | | | |
| L. fermentum NCC 2970 | | 4,3-α-GT | 983 GFRIDAADDMD | 1020 HLSYNEGYGPG | 1092 YVTNHDIR--ANLINQ | 1446 EDIVMNQ |
| B | | | | | | |
| Lactobacillus reuteri 121 (GtfB) | AAU08014.2 | 4,6-α-GT | 1011 GFRVDAADNID | 1048 HLSYNEGYHSG | 1120 FVTNHDQR--KNLINR | 1478 EDIVMNQ |
| Lactobacillus reuteri ML1 (ML4) | AAU08003.2 | 4,6-α-GT | 1012 GFRVDAADNID | 1049 HLSINEGYHSG | 1121 FVTNHDQR--KNLINR | 1479 EDLVMNQ |
| Lactobacillus reuteri DSM 20016 (GtfW) | ABC83597.1 | 4,6-α-GT | 748 GFRVDAADNID | 785 HLVVNEGYHSG | 858 FVTNHDQR--KNVINQ | 1215 EDLVMNQ |
| Lactobacillus salivarius GJ-24 | EGM52218.1 | ND | 1026 GFRIDAADHID | 1063 HLSYNEGYRSG | 1134 YVTNHDQR--ANLINQ | 1485 VDIVMNQ |
| Pediococcus pentosaceus IE-3 | CCG90643.1 | ND | 380 GFRVDAADNID | 417 HLSYNEGYHSG | 489 FVTNHDQR--KNLINS | 841 EDIVMNQ |
| Lactobacillus plantarum 16 | WP_016526729.1 | ND | 749 GFRVDAADHID | 786 HLVINEGYNYG | 859 FVTNHDQR--NNLVNR | 1201 EDLVMNQ |
| Lactobacillus fermentum ATCC 14931 | EEI21226.1 | ND | 406 GFRIDAADNID | 443 HLIINEGYHSG | 512 FVTNHDQR--KNLINQ | 862 EDLVMNQ |
| Lactobacillus acidipiscis KCTC 13900 | WP_035631372.1 | ND | 296 GFNDAADNID | 333 HLVVNEGYHSG | 406 FVTNHDQR--KNVINQ | 765 VIMVMNQ |
| Lactobacillus delbrueckii JCM 17838 | WP_050952694.1 | ND | 265 GFRIDAADNID | 302 HLSYNEGYHLG | 374 FVTNHDQR--KNLINR | 732 EDIVMNQ |
| Lactobacillus panis DSM 6035 | KRM25865.1 | ND | 988 GFRVDAADNVD | 1025 HLIVNEGYHSD | 1097 FVTNHDQR--ANLINQ | 1455 EDLVMNQ |
| Leuconostoc mesenteroides | WP_059442690.1 | ND | 252 GFRIDAADHID | 289 HLIYNEGYRSG | 360 FVTNHDQR--ANLING | 711 EDIVMNQ |
| C | | | | | | |
| Exiguobacterium sibiricum 255-15 | ACB62096.1 | | 403 GFRIDAASHYD | 433 HLSIYESYKSE | 504 FVNNHDQR--KNRVNQ | 138 MDLVPNQ |
| D | | | | | | |
| Azotobacter chroococcum NCIMB 8003 | AJE22990.1 | 4,6-α-GT | 467 GFRIDAASHIN | 500 HLSYESYVTQ | 567 FVNNHDQR--HNIIVT | 202 VDVVPNQ |
| | | | NU | A/B | TS | |
| E | | | | | | |
| Lactobacillus reuteri 180 (Gtf180) | AAU08001.1 | Dextransucrase | 1021 GIRVDAVDNVD | 1058 HINILEDWGRD | 1131 FVRAHDSWAQDQIRQ | 1503 ADWVPDQ |
| Lactobacillus reuteri 121 (GtfA) | AAU08015.1 | Reuteransucrase | 1020 SVRVDAPDNID | 1056 HINILEDWNHA | 1128 FVRAHDNSQDQIQN | 1508 ADWVPDQ |
| Streptococcus mutans SI (GtfSI) | BAA26114.1 | Mutansucrase | 473 SIRVDAVDNVD | 510 HLSILEAWSYN | 583 FIRAHDSEVQDLIRD | 954 ADWVPDQ |
| Leuconostoc mesenteroides NRRL-1355 | CAB65910.2 | Alternansucrase | 631 GIRVDAVDNVD | 668 HLSILEDWNGK | 762 FVRAHDYDAQDPIRK | 1168 ADWVPDQ |
| Leuconostoc citreum NRRL B-1299 | CDX66820.1 | (1→2) Branching sucrase | 2206 SIRLDAVDFIH | 2243 HLSILVEAGLDA | 2317 IIHARDKGVQERVGA | 2688 ADVVDNQ |
| Leuconostoc citreum NRRL B-742 | CDX65123.1 | (1→3) Branching sucrase | 667 SMRLDAISFVD | 704 HISIVEAPKGE | 783 IVHAHDIODTVIH | 1182 ADFVANQ | a. H5 of →4)-α-D-Glcp-(1→3)-
b. H3 of →4)-α-D-Glcp-(1→3)-
c. H3 of →4)-α-D-Glcp-(1→4)-
d. H4 of α-D-Glcp-(1→3)-
e. H4 of α-D-Glcp-(1→4)-
f. H4:C4 of →4)-α-D-Glcp-
g. H3:C3 of →3)-α-D-Glcp-
y. interresidual H1:H3
z. interresidual H1:H4

ALPHA GLUCANS

CROSS REFERENCE TO RELATED APPLICATIONS

The present application is a National Stage of International Application No. PCT/EP2017/063214, filed on May 31, 2017, which claims priority to European Patent Application No. 16172606.2, filed on Jun. 2, 2016, the entire contents of which are being incorporated herein by reference.

FIELD OF THE INVENTION

The present invention relates to the field of poly- and oligosaccharides and their dietary effects. In particular it relates to a method of producing an α-glucan containing (α1→3) linked D-glucose units. The invention also provides a branched α-glucan comprising alternating (α1→4) and (α1→3) glucosidic linkages and having (α1→3,4) branching points, a food composition, and the use of an α-glucanotransferase enzyme for reducing the digestible carbohydrates of a starch containing food material. Further aspects of the invention are a bacteria, an enzyme and an expression vector.

BACKGROUND OF THE INVENTION

The prevalence of obesity and being overweight is rapidly increasing worldwide. The development of foods with high satiating capacities and low energy densities may help to prevent weight gain and to stimulate weight loss. Consumption of food and drinks containing non-digestible carbohydrates instead of sugars induces a lower blood glucose rise after meals compared to sugar-containing food and drinks.

The most common carbohydrate in human diets is starch. This polysaccharide is produced by most green plants as an energy store. It is contained in large amounts in such staple foods as potatoes, wheat, maize, rice, and cassava. Various methods have been proposed for the chemical modification of starch and malto-oligosaccharides into non-digestible carbohydrates.

EP2427565 describes the use of a glucanotransferase enzyme of *Lactobacillus reuteri* 121 GTFB to convert starch into linear gluco-oligosaccharides containing relatively long isomalto-oligosaccharide units. Such materials are partially resistant to digestion and hence give less glucose production on consumption, contributing to the prevention of obesity and type II diabetes.

Amylose is an α-glucan having exclusively (α1→4) linkages and high digestibility. Introducing (α1→3) linked D-glucose units reduces the digestibility. Lichens from the genus *Cladonia* produce α-glucans with alternate (α1→3) and (α1→4) linkages in linear structures [Woranovicz-Barreira et al., Phytochemistry, 52, 1069-1074 (1999)], but these α-glucans are water insoluble, limiting their dietary applications.

It would be desirable to provide further means for the enzymatic modification of starch, starch derivatives and malto-oligosaccharides in order to change their functional properties and enhance their nutritional value. The materials obtained should ideally combine low digestibility with good solubility. In particular it would be beneficial to provide enzymes to perform such modifications which are suitable for use in food manufacture and exhibit good enzyme activity and thermostability.

Any reference to prior art documents in this specification is not to be considered an admission that such prior art is widely known or forms part of the common general knowledge in the field. As used in this specification, the words "comprises", "comprising", and similar words, are not to be interpreted in an exclusive or exhaustive sense. In other words, they are intended to mean "including, but not limited to".

SUMMARY OF THE INVENTION

An object of the present invention is to improve the state of the art and to provide an improved solution for the enzymatic modification of starch and other polysaccharide or oligosaccharide into materials having reduced digestibility, or at least to provide a useful alternative. The object of the present invention is achieved by the subject matter of the independent claims. The dependent claims further develop the idea of the present invention.

Accordingly, the present invention provides in a first aspect a method of producing an α-glucan containing (α1→3) linked D-glucose units, the method comprising contacting a polysaccharide or oligosaccharide substrate comprising at its non-reducing end at least two (α1→4) linked D-glucose units with an α-glucanotransferase enzyme capable of cleaving (α1→4) glucosidic linkages and introducing new (α1→3) glucosidic linkages to form a glucose polymer having linear segments of (α1→4) linked D-glucose units interspersed with (α1→3) glucosidic linkages, without forming consecutive (α1→3) glucosidic linkages; wherein said α-glucanotransferase is selected from the group consisting of GTFB, GTFC and GTFD types of enzyme, or a functional homolog thereof having the specified enzymatic activity.

In a second aspect, the invention relates to an α-glucan comprising linear segments of (α1→4) linked D-glucose units interspersed with (α1→3) glucosidic linkages and having (α1→3,4) branching points wherein the α-glucan has a ratio of branching of at least 3%, comprises less than 1 wt. % consecutive (α1→3) linkages and has an average molecular mass between $5 \times 10^2$ Da and $1 \times 10^7$ Da. A third aspect of the invention relates to a food composition comprising an α-glucan comprising linear segments of (α1→4) linked D-glucose units interspersed with (α1→3) glucosidic linkages and having (α1→3,4) branching points wherein the α-glucan has a ratio of branching of at least 3%, comprises less than 1 wt. % consecutive (α1→3) linkages and has an average molecular mass between $5 \times 10^2$ Da and $1 \times 10^7$ Da.

A further aspect of the invention is the use of an α-glucanotransferase enzyme that comprises an amino acid sequence having at least 80% identity to SEQ ID NO:1 for reducing the digestible carbohydrates of a starch containing food material. A still further aspect of the invention is the bacterial strain *Lactobacillus fermentum* CNCM I-5068 (NCC 2970).

Lactic acid bacteria possess a diversity of glucansucrase (GS) enzymes that belong to glycoside hydrolase family 70 (GH70) and convert sucrose into α-glucan polysaccharides via the formation of (α1→2)-, (α1→3)-, (α1→4)- and/or (α1→6)-glycosidic bonds. In recent years 3 novel subfamilies of GH70 enzymes, inactive on sucrose but using maltodextrins/starch as substrates, have been established (e.g. GTFB of *Lactobacillus reuteri* 121, described in EP2248907). Compared to the broad linkage specificity found with GSs, all characterized non-sucrose utilizing GH70 enzymes exclusively display 4,6-α-glucanotransferase activity (4,6-α-GTase). They cleave (α1→4)-linkages and synthesize new (α1→6)-linkages, yielding a linear (α1→6) α-glucan chain or a branched polymer with alternating α(1→4)/(1→6) linkages.

The inventors identified a single gene coding for a putative GTFB-like enzyme (1593 amino acids, 180 kDa) in the genome of *Lactobacillus fermentum* NCC 2970. This protein shares 77% sequence identity with the *L. reuteri* 121 GTFB 4,6-α-GTase, but shows unique variations in some of the residues forming the substrate binding residues in GSs. Biochemical characterization of this *L. fermentum* GTFB enzyme, including a detailed structural analysis of its products from amylose, revealed that it acts as a 4,3-α-glucanotransferase (4,3-α-GTase) cleaving (α1→4)-linkages and forming new (α1→3)-linkages in linear or branched orientation. This enzyme is unable to synthesize consecutive (α1→3)-linkages and its activity results in the formation of a novel type of α-glucan with alternating α(1→3)/(1→4)-linkages and with (1→3,4) branching points. The discovery of this novel reaction specificity in GH70 family and clan GH-H expands the range of α-glucans that can be synthesized and allows the identification of key positions governing the linkage specificity within the active site of the GTFB-like GH70 subfamily of enzymes.

1D $^1$H NMR analysis of the α-glucan formed by the *Lactobacillus fermentum* GTFB enzyme revealed the presence of (α1→4) and (α1→3) linkages. Methylation analysis of the α-glucan revealed the presence of terminal, 3-substituted, 4-substituted, and 3,4-disubstituted glucopyranose residues. The presence of 3-substituted, and 3,4-disubstituted glucopyranose residues means that the GTFB enzyme forms (α1→3) linkages in linear and branched orientation. Only trace amounts (less than 1%) of (α1→6) linkages were detected. No evidence was observed for two consecutive (α1→3)-linked glucopyranose residues by 2D NMR spectroscopy and Smith degradation analysis. Thus, all 3-substituted glucopyranose residues detected by methylation analysis must either be (α1→4) linked, forming a (α1→3) branching point in the structure, or be part of a linear segment of (α1→4) linkages interspersed with single (α1→3) linkages.

DESCRIPTION OF THE DRAWINGS

FIG. 2 shows the sequence alignment of conserved motifs I-IV in the catalytic domain of the *L. fermentum* 4,3-α-GT GTFB enzyme (A), (putative) GTFB-like 4,6-α-GTase enzymes (B), *E. sibiricum* GTFC 4,6-α-GTase enzyme (C), *A. chroococcum* GTFD 4,6-α-GTase enzyme (D), and glucansucrase enzymes (E). The seven strictly conserved amino acid residues in GH70 enzymes (indicated by the numbers 1 to 7 above the sequences) are also conserved in the novel *L. fermentum* 4,3-α-GT GTFB protein. Amino acids that constitute the catalytic triad are shown in bold and lightly shaded. Symbols: NU=nucleophile, A/B=general acid/base, TS=transition state stabilizer. Figure discloses SEQ ID NOs: 5-84, respectively, in order of appearance.

(w v$^{-1}$) amylose V with the *L. fermentum* GTFB enzyme (25 µg ml$^{-1}$ recorded at 300K in D2O. Peaks for (α1→4) and (α1→3) anomeric signals have been indicated. Structural-reporter signals are indicated.

Figure 10:
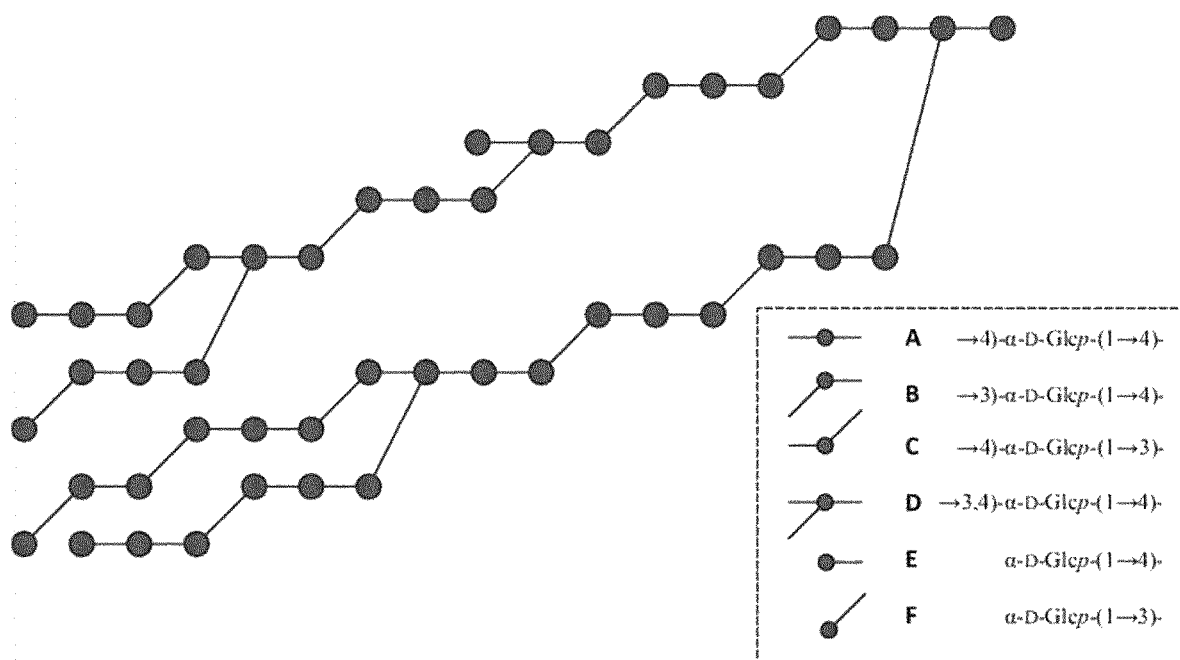

FIG. 10 is a composite model of the *L. fermentum* GTFB polysaccharide product, taking into account all structural elements identified by 1D and 2D NMR spectroscopy analysis, methylation analysis and Smith Degradation analysis. Residue labels correspond with those in Table 3.

Figure 11:
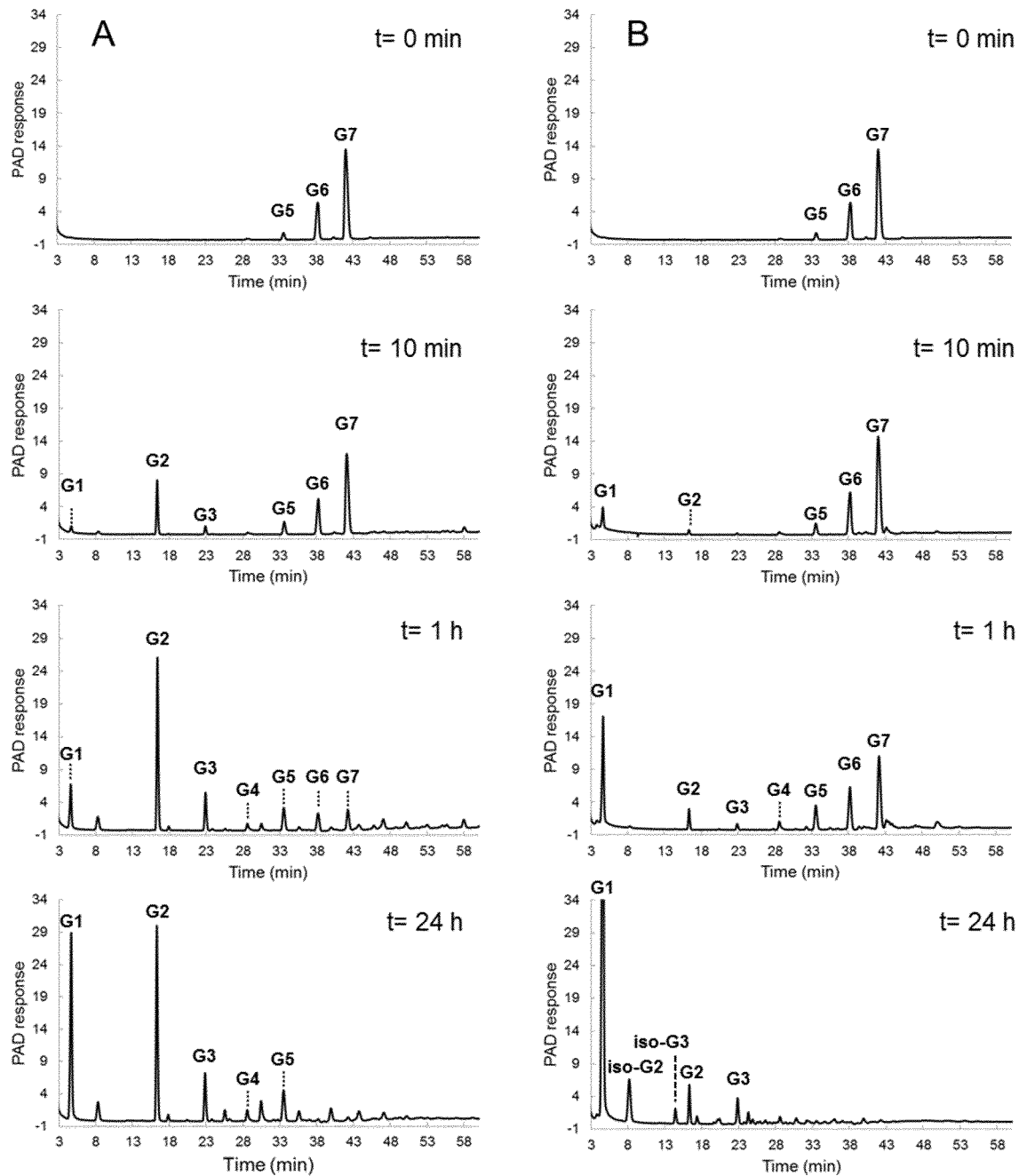

FIG. 11 shows a HPAEC-PAD profile of the oligosaccharide mixture formed upon the incubation of maltoheptaose with 25 µg ml$^{-1}$ of (A) *L. fermentum* GTFB, and (B) *L. reuteri* 121 GTFB for t=10 min, 1 h, and 24 h (pH 5.5, 37° C.). Established oligosaccharide structures. The identity of peaks was assigned using commercial oligosaccharide standards.

Figure 12:
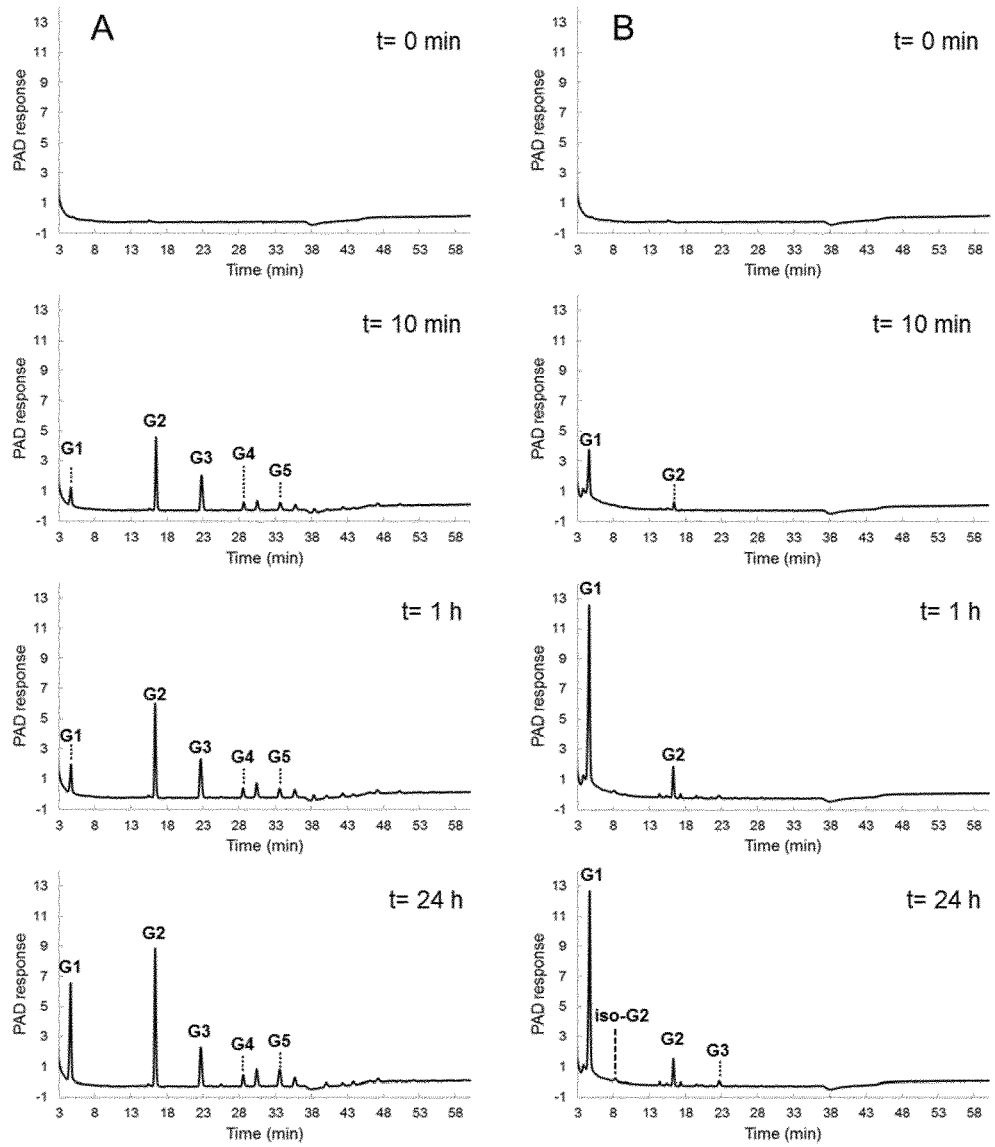

FIG. 12 shows a HPAEC-PAD profile of the oligosaccharide mixture formed upon the incubation of amylose V with 25 µg ml$^{-1}$ of (A) *L. fermentum* GTFB, and (B) *L. reuteri* 121 GTFB for t=10 min, 1 h, and 24 h (pH 5.5, 37° C.). Established oligosaccharide structures. The identity of peaks was assigned using commercial oligosaccharide standards.

Figure 13:
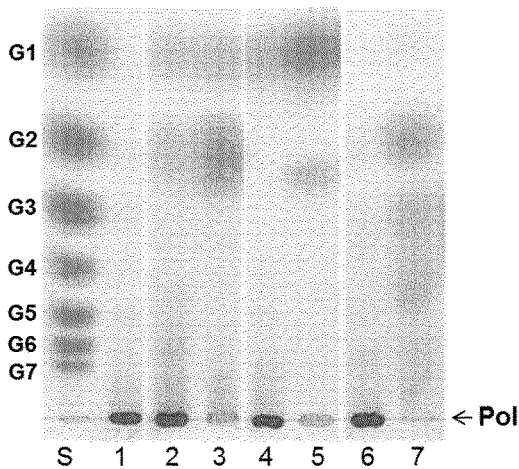

FIG. 13 is a TLC analysis of the *L. fermentum* GTFB polymer after treatment with *Aspergillus oryzae* α-amylase, *Chaetomium erraticum* dextranase and *Klebsiella planticola* pullulanase M1. Lane 1, *L. fermentum* GTFB polymer before the enzymatic treatments; Lanes 2-3, product mixtures generated by the α-amylase enzymatic treatment of the *L. fermentum* GTFB polymer and starch, respectively. Lanes 4-5, product mixtures generated by the dextranase enzymatic treatment of the *L. fermentum* GTFB polymer and IMMP, respectively. Lanes 6-7, product mixtures generated by the pullulanase enzymatic treatment of the *L. fermentum* GTFB polymer and the *A. chroococcum* GTFD polymer, respectively. Lane S, standard; G1, glucose; G2-G7, maltose to maltoheptaose; Pol, polymer.

DETAILED DESCRIPTION OF THE INVENTION

Consequently the present invention relates in part to a method of producing an α-glucan containing (α1→3) linked D-glucose units, the method comprising contacting a polysaccharide or oligosaccharide substrate comprising at its non-reducing end at least two (α1→4) linked D-glucose units with an α-glucanotransferase enzyme capable of cleaving (α1→4) glucosidic linkages and making new (α1→3) glucosidic linkages to form a glucose polymer having linear segments of (α1→4) linked D-glucose units interspersed with (α1→3) glucosidic linkages, without forming consecutive (α1→3) glucosidic linkages; wherein said α-glucanotransferase is selected from the group consisting of GTFB, GTFC and GTFD types of enzyme (for example a GTFB type of enzyme), or a functional homolog thereof having the specified enzymatic activity.

Polysaccharides are polymeric carbohydrate molecules composed of long chains of monosaccharide units bound together by glycosidic linkages. Oligosaccharides are saccharide polymers containing a small number (typically three to nine) of monosaccharides. Glucose polymers are saccharide polymers where the monosaccharide is glucose. α-Glucans are polysaccharides of D-glucose monomers linked with glycosidic bonds of the alpha form. An example of a substrate comprising at its non-reducing end at least two (α1→4) linked D-glucose units is amylose.

Linear segments are parts of the polymer's structure which are not branched, for example a chain of mono-substituted glucopyranose residues. In the context of the present invention, the term "interspersed" means occurring between. In the linear segments of (α1→4) linked D-glucose units interspersed with (α1→3) glucosidic linkages, the sequence of linkages has one or more (α1→4) linkages, then an (α1→3) linkage and then one or more (α1→4) linkages. In the linear segment the (α1→3) linkage occurs between (α1→4) linkages. The (α1→3) glucosidic linkages in this configuration are sometimes called "bridging" linkages.

The method of the invention may comprise contacting a polysaccharide or oligosaccharide substrate comprising at its non-reducing end at least two (α1→4) linked D-glucose units with an α-glucanotransferase enzyme capable of cleaving (α1→4) glucosidic linkages and making new (α1→3) glucosidic linkages to form a glucose polymer having linear segments of (α1→4) linked D-glucose units interspersed with (α1→3) glucosidic linkages, without forming consecutive (α1→3) glucosidic linkages; wherein said α-glucanotransferase is capable of forming (α1→3,4) branching points and is selected from the group consisting of GTFB, GTFC and GTFD types of enzyme (for example a GTFB type of enzyme), or a functional homolog thereof having the specified enzymatic activity.

The α-glucan produced by the method of the invention may have a ratio of branching of at least 3%, for example at least 5%, for further example at least 7%. In the context of the present invention, the ratio of branching is defined as the total number of branching anhydroglucose units (AGU), i.e. AGU being bound to three other units, with respect to the total number of AGU of a molecule. The ratio of branching can be determined by methods known in the art, such as methylation followed by gas chromatography. The more branching is present in an α-glucan, the less access is provided to digestive enzymes and so the α-glucan can present a lower digestibility. In addition, the presence of branching points can increase the solubility of the α-glucan. It is advantageous that the method of the invention can provide an α-glucan that combines low digestibility with good solubility.

The α-glucan produced by the method of the invention may comprise at least one (α1→4) glucosidic linkage adjacent to an (α1→3) glucosidic linkage and at least one (α1→3,4) branching point. The α-glucan produced by the method of the invention may comprise between 50 and 70 percent (α1→4) glucosidic linkages, between 8 and 30 percent single (α1→3) glucosidic linkages and between 3 and 20 percent (α1→3,4) branching points, for example between 5 and 15 percent (α1→3,4) branching points. The α-glucan produced by the method of the invention may have less than 1% consecutive (α1→3) glucosidic linkages, for example it may have less than 0.5% consecutive (α1→3) glucosidic linkages, for further example it may have no consecutive (α1→3) glucosidic linkages. The α-glucan produced by the method of the invention may have less than 1% (α1→6) glucosidic linkages, for example it may have less than 0.5% (α1→6) glucosidic linkages, for further example it may have no (α1→6) glucosidic linkages. The percentage of linkages refers to the number of linkages as a percentage of the total number of linkages.

Four conserved regions have been identified in the catalytic domain of GTF enzymes. Previous protein engineering studies have demonstrated that amino acid residues located in conserved sequence region III and IV (see FIG. 2 for a sequence alignment) control the product specificity of GTF enzymes regarding the glycosidic bond type formed. Also region I and region II contain amino acid residues that contribute to enzyme activity and reaction specificity. The α-glucanotransferase in the method of the invention may comprise at least one of the following mutations within the conserved regions of the GTFB protein (see FIG. 2).

A) (conserved region II): An Asp at D991 (instead of a Asn at N1019 in *L. reuteri* GTFB 4,6-α-glucanotransferase)

B) (conserved region IV): An Ile at 11098 (instead of a Gln at Q1126 in *L. reuteri* GTFB 4,6-α-glucanotransferase)

C) (conserved region IV): An Asn at N1100 (instead of a Lys at K1128 in *L. reuteri* GTFB 4,6-α-glucanotransferase)

The α-glucanotransferase in the method of the invention may comprise an amino acid sequence having at least 90% identity to SEQ ID NO:1 (for example at least 92, 95, 96, 97, 98, or 99% identity to SEQ ID NO:1).

The α-glucanotransferase in the method of the invention may be a *Lactobacillus fermentum* GTFB enzyme, for example the α-glucanotransferase in the method of the invention may be a *Lactobacillus fermentum* CNCM I-5068 GTFB enzyme. In one aspect, the invention provides a method for producing an α-glucan containing (α1→3) linked D-glucose units, the method comprising contacting a polysaccharide or oligosaccharide substrate comprising at its non-reducing end at least two (α1→4) linked D-glucose units with an α-glucanotransferase comprising (for example consisting of) an amino acid sequence having at least 90% identity to SEQ ID NO:1 (for example a *Lactobacillus fermentum* CNCM I-5068 GTFB enzyme).

The substrate in the method of the invention may have a degree of polymerization of at least five, for example it may comprise at least five D-glucose units. The degree of polymerization is the number of monomeric units in a polymer or oligomer molecule. For example, the substrate in the method of the invention may have a degree of polymerization of at least six, for example it may comprise at least six D-glucose units. The substrate in the method of the invention may be selected from the group consisting of starch (for example waxy starch or high amylose starch), starch derivatives, malto-oligosaccharides, gluco-oligosaccharides, amylose, amylopectin, maltodextrins, (α1→4) glucans and combinations thereof. Starch derivatives are prepared by physically, enzymatically, or chemically treating native starch to change its properties.

The substrate in the method of the invention may be comprised within another material, for example the substrate may be starch provided in the form of flour. It is advantageous to be able to convert polysaccharides or oligosaccharides comprised within food ingredients into α-glucans with lower digestibility, for example branched α-glucans. Such a conversion may increase the fibre content of the ingredients and/or may aid in reducing the calorie content of the ingredients. The method of the invention may be performed as part of a food processing operation, for example the α-glucanotransferase enzyme may be applied to food ingredients during a process to produce a food product. The substrate may be comprised within a material which already has a positive nutritional profile, for example the substrate may be comprised within wholegrain flour.

The extent to which the polysaccharide or oligosaccharide substrate may be converted by the α-glucanotransferase enzyme in the method of the invention can be adjusted by limiting the time of reaction. Partially converted substrates will provide different physical properties. The production of α-glucan in the method of the invention may be stopped before the reaction between the substrate and the α-glucanotransferase enzyme has reached completion, for example it may be stopped by denaturing (e.g. by heat) or removing the enzyme.

The α-glucanotransferase enzyme in the method of the invention may be immobilized, for example immobilized before contacting the polysaccharide or oligosaccharide substrate. Such immobilization techniques are well known in the art. Removal of the enzyme (discussed above) may be facilitated by immobilization of the enzyme. Immobilization techniques may be selected from the group consisting of covalent binding, entrapment, physical adsorption, cross-linking and combinations of these. In immobilization by covalent binding, enzymes are covalently linked to a support through the functional groups in the enzymes that are not essential for the catalytic activity. Oxides materials such as alumina, silica, and silicated alumina can be used for covalent binding of the enzyme. In immobilization by entrapment the enzyme is localized within the lattice of a polymer matrix or membrane. Entrapment methods are classified into five major types: lattice, microcapsule, liposome, membrane, and reverse micelle. The enzyme is entrapped in the matrix of various synthetic or natural polymers. Alginate, a naturally occurring polysaccharide that forms gels by ionotropic gelation is one such immobilization matrix. Immobilization by physical adsorption is the simplest and the oldest method of immobilizing enzymes onto carriers. Immobilization by adsorption is based on the physical interactions between the enzymes and the carrier, such as hydrogen bonding, hydrophobic interactions, van der Waals force, and their combinations. Adsorption is generally less disruptive to the enzymes than chemical means of attachment. Immobilization by cross-linking utilizes bi- or multifunctional compounds, which serve as the reagent for intermolecular cross-linking of the enzymes. Cross-linking may be used in combination with other immobilization methods such as adsorption or entrapment.

The polysaccharide or oligosaccharide substrate may be contacted with an α-glucanotransferase enzyme at a temperature of between 20° C. and 60° C. (for example between 40° C. and 55° C.) and a pH of between 3.5 to 8.0 (for example between 5.5 and 7.5).

In a further embodiment the present invention pertains to an α-glucan comprising linear segments of (α1→4) linked D-glucose units interspersed with (α1→3) glucosidic linkages and having (α1→3,4) branching points wherein the α-glucan has a ratio of branching of at least 3% (for example at least 5%, for further example at least 7%), comprises less than 1% consecutive (α1→3) linkages (for example no consecutive (α1→3) linkages) and has an average molecular mass between $5\times10^2$ Da and $1\times10^2$ Da (for example between $1\times10^4$ Da and $1\times10^6$ Da). The α-glucan of the invention may have less than 50% (α1→3) linkages.

The α-glucan of the invention may have less than 1% (α1→,6) branching points, for example it may have less than 0.5% (α1→,6) branching points, for further example it may have no (α1→,6) branching points. The α-glucan of the invention may have no branches at O2, O4 or O6 positions. The α-glucan of the invention may have less than 1% (α1→6) glucosidic linkages, for example it may have less than 0.5% (α1→6) glucosidic linkages, for further example it may have no (α1→6) glucosidic linkages.

The α-glucan of the invention may comprise at least one (α1→4) glucosidic linkage adjacent to an (α1→3) glucosidic linkage and at least one (α1→3,4) branching point. The α-glucan of the invention may comprise between 50 and 70 percent (α1→4) glucosidic linkages, between 8 and 30 percent single (α1→3) glucosidic linkages and between 3 and 20 percent (α1→3,4) branching points, for example between 5 and 15 percent (α1→3,4) branching points. The α-glucan of the invention may have less than 1% consecutive (α1→3) glucosidic linkages, for example it may have less than 0.5% consecutive (α1→3) glucosidic linkages, for further example it may have no consecutive (α1→3) glucosidic linkages. The α-glucan of the invention may have less than 1% (α1→6) glucosidic linkages, for example it may have less than 0.5% (α1→6) glucosidic linkages, for further example it may have no (α1→6) glucosidic linkages.

The α-glucan of the invention can be regarded as a dietary fiber. Due to its highly branched structure, the α-glucan will resist enzymatic degradation in the upper gastrointestinal tract and end up in the large intestine where it can be fully fermented by the colonic microflora. In addition, such dietary fibres enhance satiety in humans or animals. Blood sugar levels rise after a meal. As the α-glucans of the invention display reduced digestibility compared to materials such as starch, meals prepared containing them will cause a reduced blood glucose response compared to the equivalent meal with starch, and will provoke a lower insulin response. A composition comprising the α-glucan of the invention may be for use in the control of postprandial blood glucose and insulin levels in a subject. The subject may be a human or a pet. A composition comprising the α-glucan of the invention may be for use in the treatment or prevention of a disorder linked to an increase in postprandial blood glucose and insulin levels in a subject. The disorder may be selected from the group consisting of diabetes, for example gestational diabetes; impairment of glucose metabolism; hyperinsulinemia or insulin resistance. The subject may be a diabetic or pre-diabetic human or pet.

Typically, postprandial hyper-insulinemia may promote the development of insulin resistance, metabolic syndrome, glucose intolerance and type-2 diabetes [Kopp W., Metabolism. 2003, July; 52(7):840-844]. Lowering the insulin demand after a meal however, can reduce on one hand the deterioration of the glycemic control in type-2 diabetes and on the other hand reduce the risk of developing type-2 diabetes in predisposed subjects.

A "pre-diabetic patient" is a subject showing insulin resistance or impaired glucose metabolism and is predisposed, for example by family history, lifestyle or genetics, for developing diabetes later in life. Reducing insulin secretion reduces the risk of the pancreas becoming exhausted in the long term, and so is beneficial for management of the pancreas in pre-diabetes or patients with metabolic disorders. The use of a composition comprising the α-glucan of the invention would consequently reduce the risk and/or the development of diabetes, impaired glucose metabolism, hyperinsulinemia or insulin resistance in those subjects.

Prevalence of diabetes, insulin resistance or glucose intolerance is mostly observed in adult humans. However, more and more children are affected, or predisposed or at risk of developing such a disorder later in life. Hence, advantageously, prevention and/or treatment of those disorders is started already in young age. Alternatively, and similarly as observed with humans; diabetes, hyperinsulinemia or insulin resistance are more and more widespread among animals, particularly with animals kept as pet animals. Hence, the invention also pertains to cats and dogs.

A composition comprising the α-glucan of the invention may be for non-therapeutic use to decrease plasma postprandial glucose and insulin levels. It is advantageous that a composition comprising the α-glucan of the invention can also be administered to subjects, for example healthy subjects, which may be at risk of developing diabetes type-2, insulin resistance or glucose intolerance at some later time. A composition comprising the α-glucan of the invention, as disclosed herein, provides a reduced insulin level after consumption. Many healthy people desire to lose weight. Consuming meals which contain dietary fibre can increase satiety and therefore help people consume fewer digestible calories. A composition comprising the α-glucan of the invention may be for non-therapeutic use to lose weight.

Another aspect of the invention relates to a food composition comprising the α-glucan of the invention. The α-glucan of the invention provides a carbohydrate with low digestibility but yet a good solubility, making it ideal for use in food products where a reduced calorie content is required. The food composition may be a beverage, for example a powdered beverage mix or a beverage creamer; a breakfast cereal; a pet food product; a baked dough product, for example a bread, a pizza or a filled savoury turnover; or a confectionery product. The confectionery product may be a frozen confectionery product such as an ice-cream; a baked confectionery product such as a biscuit, for example a filled biscuit or wafer; a chocolate confectionery product; or a sugar-style confectionery product such as a gum, a jelly, a hard-boiled sweet or a chewy sweet. The term sugar-style confectionery product or sugar-style candy refers to confectionery products which would traditionally have been based on sugar, but may be manufactured with alternative sweeteners and/or sugar substitutes.

In a further embodiment, the invention provides for the use of an α-glucanotransferase enzyme that comprises an amino acid sequence having at least 90% identity to SEQ ID NO:1 (for example at least 92, 95, 96, 97, 98, or 99% identity to SEQ ID NO:1), or has the amino acid sequence of SEQ ID NO:1, for reducing the digestible carbohydrates of a food material, for example a starch-containing food material. In the scope of the current invention, digestible carbohydrates correspond to the fraction of the total carbohydrates that is digestible and available to provide energy to body cells. The α-glucanotransferase enzyme used according to the invention may be a *Lactobacillus fermentum* CNCM I-5068 GTFB enzyme.

A still further embodiment of the invention is a bacteria comprising a nucleic acid sequence having at least 90% identity to SEQ ID NO:2 (for example at least 92, 95, 96, 97, 98, or 99% identity to SEQ ID NO:2), or has the nucleic acid sequence of SEQ ID NO:2. The bacteria comprising the nucleic acid sequence identified by SEQ ID NO:2 may be a *Lactobacillus fermentum*, for example *Lactobacillus fermentum* CNCM I-5068.

An embodiment of the invention is *Lactobacillus fermentum* CNCM I-5068, also named NCC 2970. It was deposited with the Collection Nationale de Cultures de Microorganismes (CNCM), Institut Pasteur, 25 rue du Docteur Roux, F-75724 PARIS Cedex 15, France, on 8 Mar. 2016 and given the deposit number I-5068.

*Lactobacillus fermentum* CNCM I-5068 may be grown in a fermentation broth, optimizing the conditions to maximize production of the GTFB enzyme. The optimum conditions can for example be identified by measuring the expression of the enzyme by real-time polymerase chain reaction (PCR). Conversion of a polysaccharide or oligosaccharide substrate such as amylose may then be achieved using the fermentation broth, or by fermenting the *Lactobacillus fermentum* CNCM I-5068 in the presence of the polysaccharide or oligosaccharide substrate. *Lactobacillus fermentum* CNCM I-5068 may conveniently be provided in the form of a freeze-dried powder.

In a further embodiment the invention provides an α-glucanotransferase enzyme comprising an amino acid sequence having at least 90% identity to SEQ ID NO:1, for example an α-glucanotransferase enzyme consisting of an amino acid sequence having at least 90% identity to SEQ ID NO:1. The invention further provides an expression vector comprising a nucleic acid sequence encoding a polypeptide possessing at least 90% sequence identity to SEQ ID NO:1 (for example at least 92, 95, 96, 97, 98, or 99% identity to SEQ ID NO:1). The expression vector may be a vector to transform a bacteria.

Those skilled in the art will understand that they can freely combine all features of the present invention disclosed herein. In particular, features described for the method of the present invention may be combined with the product of the present invention and vice versa. Further, features described for different embodiments of the present invention may be combined. Where known equivalents exist to specific features, such equivalents are incorporated as if specifically referred to in this specification. Further advantages and features of the present invention are apparent from the figures and experimental section.

Experimental Section

Introduction

Glycoside hydrolase family 70 (www.CAZy.org) initially was established to accommodate glucansucrase enzymes converting sucrose into α-glucan polysaccharides, exclusively found in lactic acid bacteria, especially in the genera *Leuconostoc*, *Streptococcus*, *Lactobacillus*, *Weissella* and *Oenococcus*. Depending on the GS specificity, structurally different α-glucans are formed. Initially mostly glucansucrase enzymes synthesizing α-glucans with (α1→3)-(mutan) or (α1→6)-linkages (dextran) were characterized; in recent years also various α-glucans with (α1→2)- or (α1→4)-linkages have been identified as glucansucrase products. A few glucansucrase enzymes have been characterized that produce α-glucans with alternating (α1→3)/(α1→6)-linkages (alternan) (e.g. alternansucrase of *Leuconostoc mesenteroides* NRRL B-1355) or (α1→4)/(α1→6)-linkages (reuteran) (e.g. reuteransucrase of *Lactobacillus reuteri* 121). Also, branching points may be introduced, either by the same enzyme or by separate (α1→2)- or (α1→3)-branching enzymes of *L. mesenteroides* strains. GSs thus are able to synthesize all four possible linkage types of α-glycosidic bonds [(α1→2), (α1→3), (α1→4) and (α1→6)], but certain combinations of glycosidic linkages have been never found within the same α-glucan. For example, no wild-type glucansucrase enzymes synthesizing α-glucans with (α1→3) plus (α1→4)-linkages have been reported so far. The α-glucans produced by GSs also differ in their degree of branching, molecular mass, and conformation. Such differences result in α-glucans showing different functional properties with promising diverse industrial applications.

Family GH70 GS enzymes (acting on sucrose) are evolutionary related to family GH13 α-amylase enzymes (acting on maltodextrins/starch), constituting clan GH-H. Due to their evolutionary relatedness, GH70 and GH13 family enzymes display similarities in their sequence and structure, and use a comparable α-retaining double displacement catalytic mechanism. Both families have a catalytic $(\beta/\alpha)_8$ barrel structure in their proteins, with domains A, B and C, and an active site with 4 conserved regions regarded as sequence fingerprints for the individual enzyme specificities. However, GSs also exhibit unique features. In family GH13 the order of these 4 conserved regions is I-II-III-IV. In contrast, in GS enzymes this $(\beta/\alpha)_8$ barrel is circularly permuted, which results in the conserved region order II-III-IV-I, and they possess two extra and unique domains IV and V. Besides, GSs present a "U-fold" domain structure in which 4 (domains A, B, IV and V) of the 5 domains are built up from two discontinuous segments of the polypeptide chain. During their evolution from GH13, the GH70 enzymes appear to have undergone a sequence of gene rearrangements that resulted in this unusual, circularly permuted domain organization.

In recent years several maltodextrins/starch converting enzymes have been identified within the GH70 family supporting the evolutionary relatedness of GH13 and GH70 families. Firstly, it was found that *L. reuteri* 121 produced a GS-like enzyme that was inactive on sucrose. The gene encoding this enzyme was found upstream of the gene encoding the glucansucrase GTFA and designated as gtfB. Instead of sucrose, the *L. reuteri* 121 GTFB acts on maltodextrins and starch substrates, cleaving (α1→4)-linkages from the non-reducing end of the donor substrate, and synthesizing new (α1→6)-linkages on the non-reducing end of the product (4,6-α-glucanotransferase activity, 4,6-α-GTase). This results in the synthesis of products with linear chains of (α1→6)- and (α1→4)-linkages (isomalto/maltopolysaccharides, IMMP). A total of 54 related GTFB type of enzymes are currently available in databases, with 4 exceptions they are all found in the genus *Lactobacillus*, constituting a new GH70 subfamily. Following the annotation of many new genome sequences, a few family GH70 enzymes also were found in non-LAB genera. Previously the GTFC enzyme of *Exiguobacterium sibiricum* 255-15 [Gangoiti J, Pijning T, Dijkhuizen L., Appl Environ Microbiol 82:756-766. (2015)] and the GTFD enzyme of *Azotobacter chroococcum* NCIMB 8003 [Gangoiti J, van Leeuwen S, Vafiadi C, Dijkhuizen L., Biochem Biophys Act 1860: 1224-1236 (2016)] have been characterized. Both of these enzymes are inactive with sucrose and active with maltodextrins/starch, displaying 4,6-α-GTase activity that resulted in synthesis of isomaltose/maltose oligosaccharides (IMMO) (GTFC) and in a reuteran type of α-glucan (GTFD). Surprisingly, the domain order in GTFC and GTFD resembles that of GH13 enzymes, with a nonpermuted order of conserved regions I-II-III-IV, and lacking domain V found in other GH70 enzymes. GTFC and GTFD represent 2 additional GH70 subfamilies and are structurally very interesting evolutionary intermediates between GH13 α-amylase and GH70 glucansucrase enzymes, allowing further analysis of the evolutionary origins and differentiation of the (sub)families in clan GH-H (http://www.cazy.org).

Annotation of the *Lactobacillus fermentum* NCC 2970 genome sequence resulted in identification of a single family GH70 protein with clear sequence similarity to the GTFB-type of 4,6-α-GTase enzymes. It also had all features of a typical 4,6-α-GTase enzyme, being inactive with sucrose and active with maltodextrins/starch. However, the *Lb. fermentum* GTFB amino acid sequence showed unique variations in some of the residues in conserved regions II and IV, contributing to the active site donor/acceptor substrate binding subsites. The inventors therefore decided to biochemically characterize this *L. fermentum* GTFB enzyme, including a detailed characterization of its products. This revealed that it possesses 4,3-α-glucanotransferase (4,3-α-GTase) activity with maltodextrins/starch, a novel reaction specificity in family GH70 and clan GH-H.

Materials and Methods
*L. fermentum* GTFB Protein Sequence Analysis

Analysis of the *Lactobacillus fermentum* NCC 2970 genome (SEQ ID NO:2) by BLAST using the *L. reuteri* 121 GTFB (GenBank accession no. AAU08014.2) as query sequence allowed the identification of a GH70 protein encoding gene. Sequences showing similarity to the *L. fermentum* GH70 protein sequence were found using NCBI BLASTp searches (http://www.ncbi.nlm.nih.gov/BLAST/) against the non-redundant protein sequence database. Multiple amino acid sequence alignments were made with Clustal W2 using Jalview 2 desktop application. The presence of a signal peptide was analyzed using the Signal P4 server. Subcellular localization of the *L. fermentum* GTFB protein was predicted using CELLO v.2.5: subCELlular LOcalization predictor (http://cello.life.nctu.edu.tw/). The theoretical Mw (molecular weight) of the GTFB protein was predicted on ExPASy Compute pI/Mw (http://web.expasy.org/compute_pi/).

Phylogenetic analysis was performed using MEGA, version 6 (Tamura et al., 2013) with a total of 72 amino acid sequences corresponding to representative characterized GH70 proteins indexed in CAZy and GTFB-like protein sequences identified via BLASTp. Sequences were aligned by MUSCLE, using default parameters. A phylogenetic tree was constructed by the Maximum Likelihood method based on the HT matrix model using MEGA6. Partial deletion of the positions containing alignment gaps and missing data was conducted. Statistical confidence of the inferred phylogenetic relationships was assessed by performing 1,000 bootstrap replicates.

Cloning of the *L. fermentum* GTFB Gene

The DNA fragment coding for an N-terminally truncated version of the GTFB protein (amino acids 616-1593) was amplified from *L. fermentum* NCC 2970 chromosomal DNA using Phusion DNA polymerase (Finnzyme, Helsinki, Finland) and cloned into a modified pET15b vector using ligation-independent cloning (LIC). The primers used for amplifying the N-terminally truncated gtfB gene derivative incorporated 5' extensions (underlined) to facilitate the LIC cloning, and were: Forward CAGGGACCCGGTTTTGG-TAAAGATGGTCGGATTG (SEQ ID NO: 3) and Reverse CGAGGAGAAGCCCGGTTAATTGTCTTCAATATTAG-CATAATAATC (SEQ ID NO: 4). The resulting PCR product was purified from the agarose band and digested in the presence of dATP, with the 3' to 5' exonuclease activity of the T4 DNA polymerase (New England Biolabs). In parallel, the pET-15b/LIC vector was digested with KpnI, isolated from gel and then treated with T4 DNA polymerase (New England Biolabs) in the presence of dTTP. The treated pET-15b/LIC vector and the amplicon were mixed together in a 1:4 molar ratio, and the mixture was used to transform *Escherichia coli* DH5a cells (Phabagen). This resulted in a gtfB-ΔN construct containing an N-terminal His6-tag (SEQ ID NO: 85) cleavable by a 3C protease. The constructed expression vector pET15b/gtfB-ΔN was transformed into host *E. coli* BL21 Star (DE3). The gene sequence was verified by nucleotide sequencing (GATC, Cologne, Germany).

Enzyme Expression and Purification

For expression of the *L. fermentum* GTFB enzyme, an *E. coli* star BL21 (DE3) overnight culture, transformed with pET15b/gtfB-ΔN was diluted 1:100 into fresh LB broth supplemented with ampicillin (100 μg ml$^{-1}$) and grown at 37° C. and 220 rpm until the optical density at 600 nm reached approximately 0.4. The temperature for culturing was then decreased to 16° C., and the inducer isopropyl-β-D-1-thiogalactopyranoside was added to a final concentration of 0.1 mM. After 20 h, cells were harvested by centrifugation (10,000 g×20 min), and subsequently disrupted with B-PER lysis reagent in accordance to the protocol described by the manufacturer (Thermo Scientific, Pierce). The recombinant GTFB protein was isolated from the cell-free extract by His-tag affinity chromatography using Ni$^{2+}$-nitrilotriacetate (Ni-NTA) as column material (Sigma-Aldrich). After washing the column with 25 mM Tris-HCl (pH 8.0), 1 mM CaCl$_2$, bound proteins were eluted with 200 mM imidazole in the same buffer and the imidazole was removed by use of a stirred ultrafiltration unit (Amicon, Beverly, Mass.) with a 30,000 molecular weight cut off. For further purification, the protein was loaded on a 1 ml-HiTrap column (GE Healthcare) and eluted (at a 1-ml/min flow rate) using a linear gradient of NaCl (from 0 to 1 M) in 20 mM Tris-HCl buffer (pH 8.0), containing 1 mM CaCl$_2$. Fractions of 1 ml were collected using an Äkta fast protein liquid chromatograph (FPLC; GE Healthcare, Uppsala, Sweden). The buffer was exchanged by ultrafiltration (YM30 membranes; Millipore, Billerica, Mass.). The purification progress was assessed by SDS-PAGE analysis of the fractions, and the protein concentrations were determined using a Nanodrop 2000 spectrophotometer (Isogen Life Science, De Meern, The Netherlands).

Enzyme Activity Assays

The initial total activity of the *L. fermentum* GTFB-ΔN enzyme was determined by the amylose-iodine method [Gangoiti J, Pijning T, Dijkhuizen L., Appl Environ Microbiol 82:756-766. (2015)][Bai Y, van der Kaaij R M, Leemhuis H, Pijning T, van Leeuwen S S, Jin Z, Dijkhuizen L., 2015. Appl Environ Microbiol 81:7223-7232. (2015)]. The decrease in absorbance of the α-glucan-iodine complex resulting from transglycosylation and/or hydrolytic activity was monitored at 660 nm for 14 min at 40° C. The reaction mixture contained 0.125% (w v$^{-1}$) amylose V (AVEBE, Foxhol, The Netherlands), 2.5 μg ml$^{-1}$ of enzyme, 25 mM sodium acetate (pH 5.5) and 1 mM CaCl$_2$. One unit of activity was defined as the amount of enzyme converting 1 mg of substrate per min.

The effect of pH on enzyme activity was determined at 40° C. by varying the pH between 3.5 and 8.0. Sodium citrate buffer (25 mM) was used for pH values between 3.5 and 7.0, and sodium phosphate buffer (25 mM) for pH values between 7.0 and 8.0. The optimal temperature was determined in 25 mM sodium citrate buffer, pH 5.5, 1 mM CaCl$_2$, at temperatures ranging from 30 to 65° C. The effect of temperature on GTFB-ΔN stability was determined by incubating the enzyme at a concentration of 0.1 mg ml$^{-1}$ in 20 mM Tris-HCl buffer (pH 8.0) with 1 mM CaCl$_2$, at temperatures from 30 to 55° C. for 10 min. Samples were then immediately cooled to 4° C., and the residual activity was measured under the standard reaction conditions in 25 mM sodium citrate (pH 5.5) with 1 mM CaCl$_2$ at 40° C.

Substrate Utilization by *L. fermentum* GTFB

*L. fermentum* GTFB-ΔN (25 μg ml$^{-1}$) was separately incubated with 25 mM sucrose (Acros), nigerose (Sigma-Aldrich), panose (Sigma-Aldrich), isomaltose (Sigma-Aldrich), isomaltotriose (Sigma-Aldrich), isomaltopentaose (Carbosynth), malto-oligosaccharides (MOS) with degrees of polymerization (DP) 2-7, and 0.6% (w/v) amylose V (AVEBE, Foxhol, The Netherlands), potato starch (Sigma-Aldrich) and amylopectin (Sigma-Aldrich). All reactions were performed in 25 mM sodium acetate buffer (pH 5.5) with 1 mM CaCl$_2$ at 37° C. for 24 h. Reactions were stopped by 6 min of incubation at 100° C. The progress of the reactions was monitored by thin-layer chromatography (TLC) and/or high-performance-anion-exchange chromatography (HPAEC).

Thin Layer Chromatography and High Performance Anion Exchange Chromatography with Pulsed Amperometric Detection Analysis Thin layer chromatography (TLC) was performed on silica gel 60 F254, 20×20 cm TLC sheets (Merck, Darmstadt, Germany). The TLC plates were developed in n-butanol:acetic acid:water (2:1:1, v/v) solvent system for 6 h. The carbohydrates were visualized with orcinol/sulfuric acid staining and compared with a simultaneous run of a mixture of glucose and MOS (DP2 to DP7).

Carbohydrate samples were diluted 3:100 in DMSO and analyzed by HPAEC on a Dionex DX500 workstation (Dionex, Amsterdam, The Netherlands), equipped with a CarboPac PA-1 column (Dionex; 250×2 mm) and a ED40 pulsed amperometric detection system. A gradient of sodium acetate from 10 to 240 mM in 100 mM NaOH was applied over 57 min at 0.25 ml min$^{-1}$ flow rate. The injection volume of each sample was 5 µl. The identity of the peaks was assigned using commercial oligosaccharide standards.

HPSEC Analysis

HPSEC analyses of the products mixtures were performed using a size exclusion chromatography system (Agilent Technologies 1260 Infinity) equipped with a multi angle laser light scattering detector (SLD 7000 PSS, Mainz), a viscometer (ETA-2010 PSS, Mainz) and a differential refractive index detector (G1362A 1260 RID Agilent Technologies), [Gangoiti J, van Leeuwen S, Vafiadi C, Dijkhuizen L., Biochem Biophys Act 1860: 1224-1236. (2016)]. Separation was carried out by using three PFG-SEC columns with porosities of 100, 300 and 4000 Å, coupled with a PFG guard column. DMSO-LiBr (0.05 M) was used as eluent at a flow rate of 0.5 ml min$^{-1}$. The system was calibrated and validated using a standard pullulan kit (PSS, Mainz, Germany) with $M_w$ ranging from 342 to 805 000 Da. The specific RI increment value dn/dc was also measured by PSS and was 0.072 ml g$^{-1}$. The multiangle laser light scattering signal was used to determine the molecular masses of the amylose V and the polymer generated by the L. fermentum GTFB-ΔN enzyme. The specific RI increment value, dn/dc for these polysaccharides in this system was taken to be the same as for pullulan. The molecular mass of the L. reuteri GTFB-ΔN polymer was determined by universal calibration method. WinGPC Unity software (PSS, Mainz) was used for data processing. Measurements were performed in duplicate.

Production, Isolation and Characterization of the Products Synthesized by L. fermentum GTFB from Amylose Purified GTFB-ΔN (0.25 mg) was incubated with amylose V for 48 h at 37° C. under the conditions described above in "Substrate utilization by L. fermentum GTFB". The product mixture obtained was fractionated by size-exclusion chromatography on a BioGel P2 column (2.5×50 cm; Bio-Rad, Veenendaal, The Netherlands) using 10 mM NH$_4$HCO$_3$ as eluent at a flow rate of 48 ml h$^{-1}$. The poly-/oligosaccharides present in the different Biogel P2 pools were analyzed by matrix-assisted laser-desorption ionization time-of-flight mass spectrometry (MALDI-TOF-MS), nuclear magnetic resonance (NMR) spectroscopy and methylation analysis.

(i) MALDI-TOF Mass Spectrometry

MALDI-TOF-MS measurements were recorded on an Axima™ mass spectrometer (Shimadzu Kratos Inc., Manchester, UK) equipped with a nitrogen laser (337 nm, 3 ns pulse width). Sample solutions (1 µL) were spotted on a MALDI target and mixed immediately with 1 µL of aqueous 10% (w v$^{-1}$) 2,5-dihydroxybenzoic acid matrix solution. Positive-ion mode spectra were recorded using the reflector mode at a resolution of 5000 Full Width at Half Maximum (FWHM) and delayed extraction (450 ns). Mass spectra were generally acquired from 1 to 5000 Da with ion-gate blanking at 200.

(ii) NMR Spectroscopy

One- and two-dimensional $^1$H nuclear magnetic resonance (NMR) spectra were recorded on a Varian Inova 500 spectrometer (NMR Center, University of Groningen), using D$_2$O as solvent and at a probe temperature of 298K. Prior to analysis, samples were exchanged twice in D$_2$O (99.9 atom % D, Cambridge Isotope Laboratories, Inc., Andover, Mass.) with intermediate lyophilization, and then dissolved in 0.6 mL of D$_2$O. All NMR spectra were processed with MestReNova 5.3 (Mestrelabs Research SL, Santiago de Compostella, Spain). Chemical shifts (δ) were expressed in ppm and calibrated with the internal standard acetone (δ 2.225 ppm for $^1$H and δ 31.07 for $^{13}$C). The percentage of different linkages was estimated by integration of the respective signal peak areas.

(iii) Methylation Analysis

Methylation analysis was performed as described previously [van Leeuwen S S, Kralj S, van Geel-Schutten I H, Gerwig G J, Dijkhuizen L, Kamerling J P., Carbohydr Res 343:1237-1250. (2008)]. Briefly, the polymer and oligosaccharides samples (~5 mg) were per-methylated using CH$_3$I and solid NaOH in DMSO, and subsequently hydrolyzed with trifluoroacetic acid. Partially methylated monosaccharides were reduced with NaBD$_4$. The resulting partially methylated alditols were per-acetylated using pyridine:acetic anhydride (1:1 v/v) at 120° C. yielding mixtures of partially-methylated alditol acetates (PMAAs). PMAAs were analyzed by GLC-EI-MS and GLC-FID as described in van Leeuwen et al., 2008.

Smith Degradation

Samples of 1-2 mg polysaccharide were dissolved in 1 mL 50 mM NaIO$_4$ in 100 mM NaOAc (pH 4.1) and stirred for 112 h at 4° C. in the dark. Excess 104 was neutralised by adding 300 µL ehtyleneglycol. The degraded product was dialysed in a SpectraPor 1000 Da cut-off dialysis floater against running tap water for 48 h. After dialysis the sample was reduced with NaBH$_4$ at room temperature overnight, followed by dialysis as described above. The reduced polysaccharide sample was lyophilized and hydrolysed in 1 mL 90% formic acid at 90° C. for 30 min. After cooling to room temperature formic acid was evaporated by N2 stream. The dried polysaccharide fragments were analysed as TMS derivatives on GLC-EI-MS and GLC-FID, and by HPAEC-PAD as described by Van Leeuwen et al., 2008.

L. fermentum GTFB Product Analysis with Hydrolytic Enzymes

L. fermentum GTFB-ΔN polymer was dissolved at a concentration of 5 mg ml$^{-1}$ in 50 mM sodium acetate buffer pH 5.0, and incubated separately with an excess of α-amylase (Aspergillus oryzae; Megazyme), dextranase (Chaetomium erraticum; Sigma-Aldrich), and pullulanase M1 (Klebsiella planticola; Megazyme) for 48 h at 37° C. Starch, IMMP L. reuteri 121 GTFB polymer and A. chroococcum reuteran-like GTFD polymer, were used as positive controls for the α-amylase, dextranase and pullulanase treatments, respectively, resulting in complete degradation under these conditions. The degree of hydrolysis was examined by TLC analysis.

Results and Discussion

*L. fermentum* GTFB Protein Sequence Analysis

Annotation of the *L. fermentum* genome resulted in identification of a single GH70 family protein. BLASTp analysis of the *L. fermentum* GH70 protein revealed that the closest homologs of this protein all were members of the GTFB-like 4,6-α-GTase GH70 subfamily with more than 47% identical amino acid sequences (Table 1).

TABLE 1

Protein sequences identified via a BLASTp search using the *L. fermentum* NCC 2970 GH70 protein as query. The sequence corresponding to the *L. reuteri* 121 GTFB 4,6-α-glucanotransferase is highlighted in bold.

| NCBI protein names | Organism | Coverage | Identity | Length | Accession |
| --- | --- | --- | --- | --- | --- |
| dextransucrase | *Lactobacillus fermentum* | 100% | 79% | 1478 | WP_046948074.1 |
| Dextransucrase | *Lactobacillus reuteri* mlc3 | 99% | 66% | 1488 | WP_019251413.1 |
| Dextransucrase | *Lactobacillus reuteri* JCM 1112 | 99% | 66% | 1488 | WP_003668618.1 |
| Dextransucrase | *Lactobacillus reuteri* DSM 20016 | 87% | 66% | 1363 | ABQ83597.1 |
| Dextransucrase | *Lactobacillus sanfranciscensis* DSM 20451 | 86% | 69% | 1151 | KRM78746.1 |
| Dextransucrase | *Lactobacillus fermentum* ATCC 14931 | 86% | 79% | 1014 | WP_003683900.1 |
| dextransucrase | *Lactobacillus fermentum* 28-3-CHN | 78% | 78% | 986 | WP_004563243.1 |
| glycosyl hydrolase family 70 | *Lactobacillus delbrueckii* subsp. *Delbrueckii* | 66% | 73% | 1294 | WP_057717954.1 |
| inactive glucansucrase | *Lactobacillus salivarius* GJ-24 | 60% | 88% | 1626 | EGM52218.1 |
| Dextransucrase | *Lactobacillus delbrueckii* subsp. *Lactis* | 66% | 73% | 1294 | WP_013439942.1 |
| glycosyl hydrolase family 70 | *Lactobacillus salivarius* GJ-24 | 53% | 88% | 852 | WP_050809355.1 |
| glycosyl hydrolase family 70 | *Lactobacillus delbrueckii* subsp. *Lactis* DSM 20072 | 62% | 76% | 1252 | WP_057727099.1 |
| glycosyl hydrolase family 70 | *Lactobacillus plantarum* AG30 | 57% | 81% | 932 | WP_033607967.1 |
| glycosyl hydrolase family 70 | *Lactobacillus delbrueckii* subsp. *Lactis* DSM 20072 | 59% | 78% | 1210 | WP_035182758.1 |
| glycosyl hydrolase family 70 | *Lactobacillus delbrueckii* subsp. *Lactis* DSM 20072 | 58% | 80% | 997 | WP_025895575.1 |
| glycosyl hydrolase family 70 | *Lactobacillus plantarum* subsp. *argentoratensis* DSM 16365 | 55% | 84% | 908 | WP_057717369.1 |
| dextransucrase | *Lactobacillus plantarum* subsp. *argentoratensis* DSM 16365 | 54% | 85% | 880 | KRL97820.1 |
| glycosyl hydrolase family 70 | *Lactobacillus delbrueckii* subsp. *bulgaricus* NDO2 | 56% | 83% | 954 | WP_035171046.1 |
| glycosyl hydrolase 70 family protein | *Lactobacillus delbrueckii* subsp. *lactis* CRL581 | 54% | 85% | 922 | EPB98082.1 |
| glycosyl hydrolase family 70 | *Lactobacillus plantarum* WLPL04 | 56% | 82% | 922 | WP_057138784.1 |
| glycosyl hydrolase 70 family protein | *Pediococcus pentosaceus* IE-3 | 57% | 81% | 926 | WP_002833996.1 |
| glycosyl hydrolase family 70 | *Lactobacillus delbrueckii* KACC 13439 | 56% | 83% | 965 | WP_052933722.1 |
| glycosyl hydrolase family 70 | *Lactobacillus delbrueckii* subsp. *delbrueckii* KACC 13439 | 54% | 85% | 922 | KNZ37797.1 |
| cell wall-binding repeat protein | *Lactobacillus delbrueckii* subsp. *bulgaricus* PB2003/044-T3-4 | 58% | 80% | 957 | EFK31460.1 |
| Dextransucrase | *Pediococcus pentosaceus* DSM 20336 | 53% | 85% | 874 | KRN47461.1 |
| glycosyl hydrolase family 70 | *Lactobacillus delbrueckii* JCM 17838 | 54% | 85% | 922 | WP_050952694.1 |
| glycosyl hydrolase family 70 | *Lactobacillus delbrueckii* subsp. *lactis* | 57% | 85% | 922 | WP_035162295.1 |
| glycosyl hydrolase family 70 | *Pediococcus pentosaceus* DSM 20336 | 54% | 84% | 883 | WP_056979574.1 |
| Dextransucrase | *Lactobacillus delbrueckii* subsp. *jakobsenii* ZN7a-9 = DSM 26046 | 54% | 80% | 966 | WP_002879779.1 |
| glycosyl hydrolase family 70 | *Lactobacillus delbrueckii* subsp. *jakobsenii* ZN7a-9 = DSM 26046 | 53% | 80% | 948 | WP_057709472.1 |
| glycosyl hydrolase family 70 | *Lactobacillus mucosae* LM1 | 53% | 84% | 881 | WP_053069107.1 |
| Dextransucrase | *Lactobacillus delbrueckii* subsp. *jakobsenii* ZN7a-9 = DSM 26046 | 53% | 85% | 895 | KR017768.1 |
| glycosyl hydrolase family 70 | *Leuconostoc mesenteroides* 406 | 53% | 85% | 850 | WP_059442690.1 |
| inactive glucansucrase | ***Lactobacillus reuteri* 121 | 57% | 77% | 1619 | AAU08014.2** |
| putative glucansucrase | *Lactobacillus reuteri* ML1 | 59% | 77% | 1620 | AAU08003.2 |
| FIG00744899: hypothetical protein | *Lactobacillus reuteri* pg-3b | 62% | 76% | 1622 | CUR36485.1 |
| hypothetical protein HQ33_10125 | *Lactobacillus reuteri* TMW1.656 | 59% | 77% | 1602 | KOF04763.1 |
| putative glucansucrase | *Lactobacillus reuteri* TMW1.106 | 53% | 77% | 1383 | ABP88725.1 |
| putative dextransucrase | *Lactobacillus plantarum* 16 | 86% | 52% | 1348 | WP_016526729.1 |

TABLE 1-continued

Protein sequences identified via a BLASTp search using the L. fermentum NCC 2970 GH70 protein as query. The sequence corresponding to the L. reuteri 121 GTFB 4,6-α-glucanotransferase is highlighted in bold.

| NCBI protein names | Organism | Coverage | Identity | Length | Accession |
| --- | --- | --- | --- | --- | --- |
| hypothetical protein | Lactobacillus sanfranciscensis DSM 20451 | 57% | 67% | 924 | WP_056958823.1 |
| inactive glucansucrase | Lactobacillus panis DSM 6035 | 57% | 67% | 1603 | KRM25865.1 |
| hypothetical protein | Pediococcus argentinicus DSM 23026 | 53% | 70% | 898 | WP_057799472.1 |
| Dextransucrase | Pediococcus argentinicus DSM 23026 | 53% | 70% | 890 | KR024973.1 |
| Dextransucrase | Lactobacillus paraplantarum DSM 10667 | 57% | 65% | 920 | KRL44364.1 |
| hypothetical protein | Lactobacillus plantarum NL42 | 57% | 65% | 907 | WP_052697219.1 |
| Dextransucrase | Lactobacillus paraplantarum DSM 10667 | 57% | 65% | 929 | WP_056988774.1 |
| hypothetical protein | Lactobacillus plantarum CI P104448 | 69% | 47% | 1266 | WP_052661628.1 |
| hypothetical protein | Lactobacillus acidipiscis KCTC 13900 | 63% | 49% | 1567 | WP_050955745.1 |
| hypothetical protein | Lactobacillus acidipiscis DSM 15353 | 60% | 51% | 1139 | WP_056988183.1 |
| dextransucrase | Lactobacillus acidipiscis DSM 15353 | 60% | 51% | 1143 | KRN79505.1 |
| Dextransucrase | Lactobacillus aviarius subsp. aviarius DSM 20655 | 99% | 50% | 1567 | KRM39240.1 |

Figure 1:
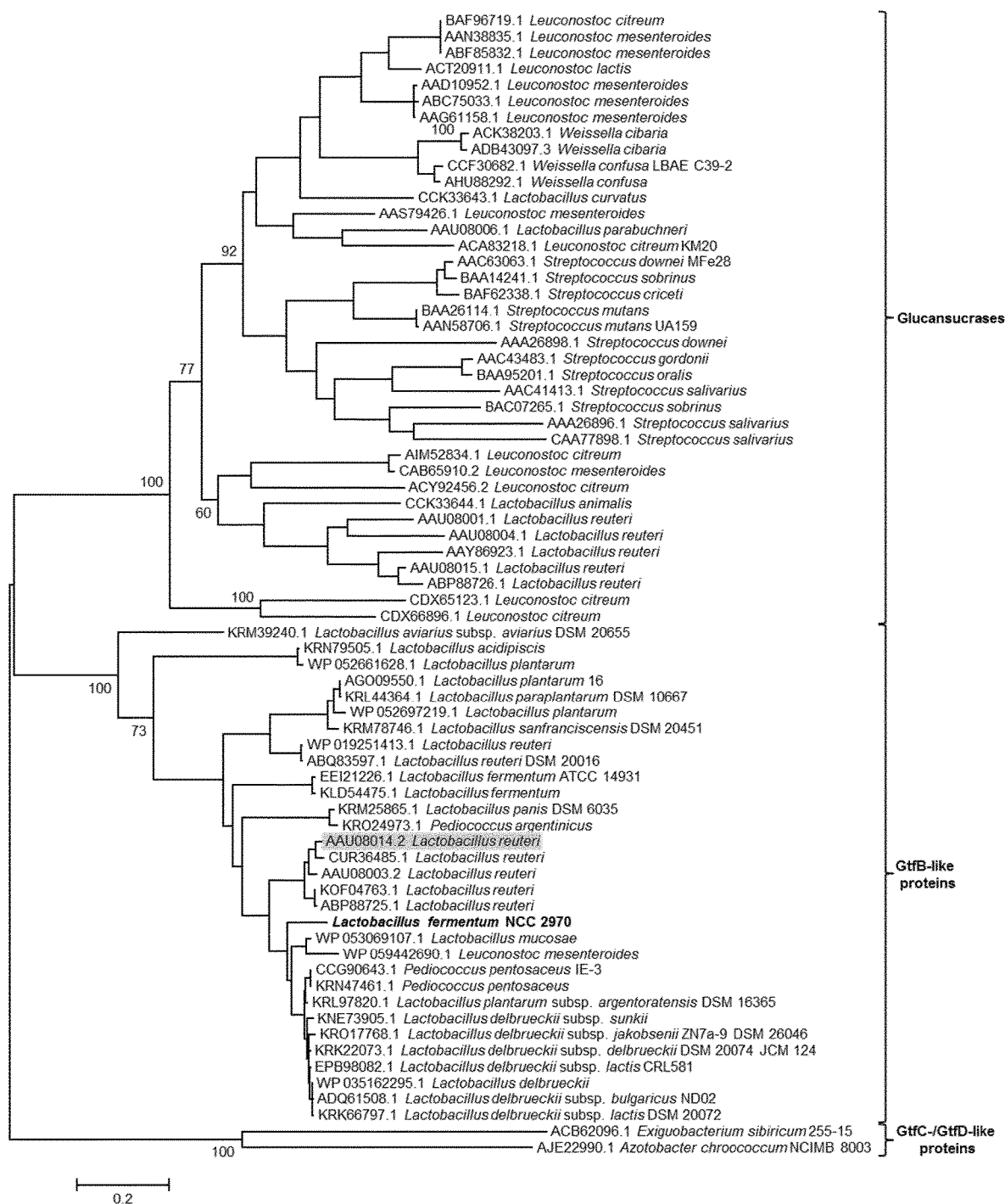
FIG. 1 shows a phylogenetic tree constructed on the basis of complete amino acid sequence alignment of some of the characterized GH70 proteins annotated in the CAZy database (http://www.CAZy.org), and of (putative) GH70 GTFB-like proteins identified by a BLAST search using the *L. fermentum* GH70 NCC 2970 protein as query sequence (shown in bold). The evolutionary history was inferred by using the Maximum Likelihood method based on the JTT matrix-based model. The bar represents a genetic distance of 0.2 substitutions per position (20% amino acid sequence difference). The bootstrap values adjacent to the main nodes represent the probabilities based on 1000 replicates. The protein sequences are annotated by their Genbank accession number and bacterial origin. The *L. reuteri* 121 GTFB 4,6-α-GTase is highlighted with a grey background.

The phylogenetic relationship of the L. fermentum GH70 protein to other characterized GH70 enzymes and (putative) GH70 4,6-α-GTases identified by this BLASTp search is depicted in FIG. 1. Glucansucrases (GSs) are present in the genomes of lactic acid bacteria of the genera Leuconostoc, Streptococcus, Lactobacillus, Oenococcus and Weissella, but most genes encoding putative GTFB homologs are currently found in Lactobacillus strains (except 4 GTFB-like proteins present in Pediococcus and Leuconostoc strains). The L. fermentum GH70 enzyme clustered together with the L. reuteri 121 GTFB 4,6-α-GTase and its homologs, indicating that this protein is a member of the GTFB-type of GH70 subfamily. The GTFB-like proteins display a domain organization resembling that of GH70 GSs with a circularly permuted $(\beta/\alpha)_8$ barrel, however, biochemically they are more related to the E. sibiricum 255-15 GTFC and A. chroococcum NCIMB 8003 GTFD enzymes. In agreement with these observations, the GTFB-like GH70 subfamily is evolutionary more closely related to GSs, but it has an intermediate position between the GSs and the GTFC and GTFD 4,6-α-GTases encoded by E. sibiricum 255-15 and A. chroococccum NCIMB 8003.

Figure 3:
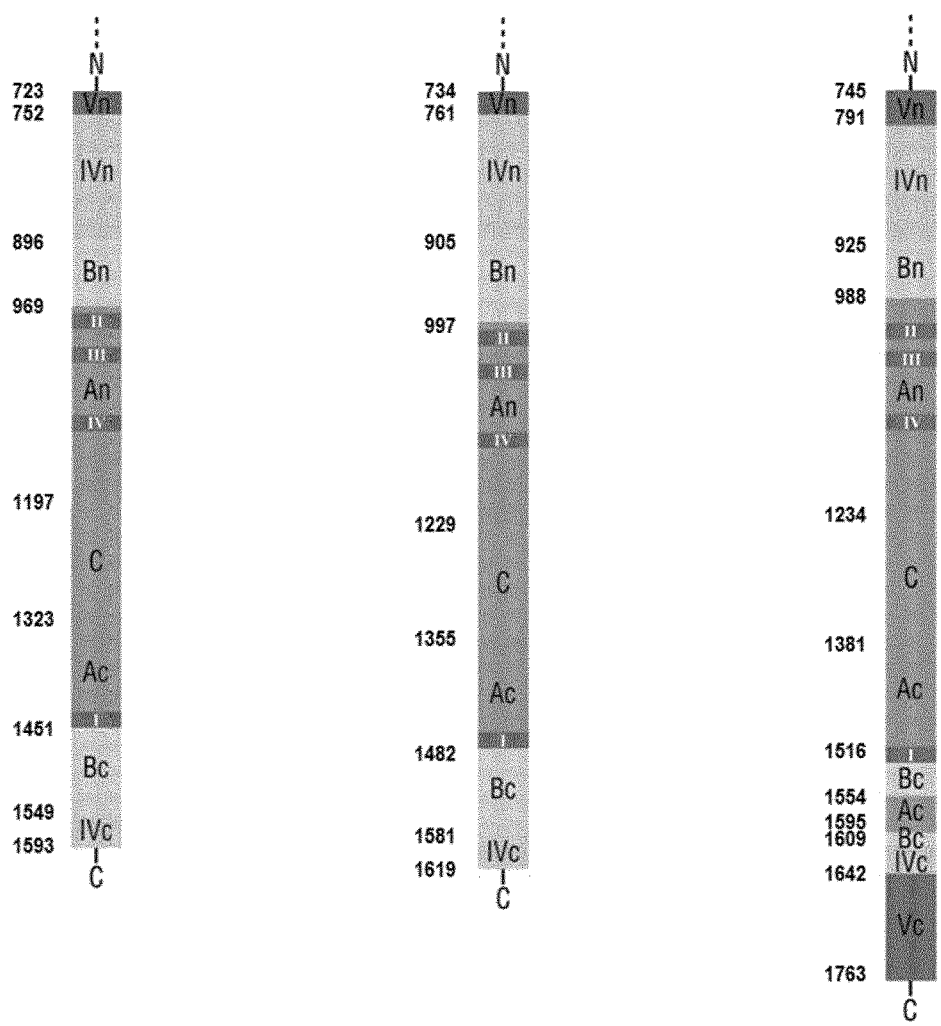
FIG. 3 shows a schematic representation of the domain arrangement along the polypeptide chains of *L. fermentum* GTFB 4,3-α-glucanotransferase, *L. reuteri* 121 GTFB-ΔN 4,6-α-glucanotransferase and *L. reuteri* 121 GTFA glucansucrase. Domains A, B, C, IV and V were identified in the *L. fermentum* GTFB primary structure by sequence comparisons with the *L. reuteri* 121 GTFB and GTFA sequences, using Clustal W2.

The identified GTFB gene sequence from L. fermentum encodes a polypeptide consisting of 1593 amino acids with a calculated molecular mass of 180 kDa. In agreement with the extracellular location of GH70 enzymes, the L. fermentum GTFB was predicted to function as an extracellular protein by the CELLO v.2.5: subCELlular LOcalization predictor server. Analysis of the N-terminus of the amino acid sequence of L. fermentum GTFB using the algorithm of the Signal P 4.0 server revealed that this protein contains the classical Gram-positive N-terminal signal peptide of 39 amino acids. The L. fermentum GTFB shares significant amino acid identity (77% identity, 57% coverage) with the L. reuteri 121 GTFB, the first characterized GH70 member with 4,6-α-glucanotransferase activity (EP2248907). Besides, the typical U-fold domain organization characteristic of most GH70 proteins consisting of five domains (A, B, C, IV and V), is also found in the L. fermentum GTFB enzyme (FIG. 3). Similar to L. reuteri 121 GTFB, domains A, B, C and IV of the L. fermentum GTFB protein are built up from discontinuous N- and C-terminal stretches of the polypeptide chain, whereas domain V only consists of an N-terminal polypeptide segment. Besides, the L. fermentum GTFB has a large variable N-terminal domain of ~700 residues present in many glucansucrases and GTFB-like proteins of Lactobacillus species that is believed to be involved in cell wall attachment [Bath K, Roos S, Wall T, Jonsson H. FEMS Microbiol Lett 253:75-82. (2005)].

Aiming to predict the reaction and/or product specificity of the L. fermentum GTFB enzyme, the homology regions I-IV of this protein were identified by sequence alignments with other GH70 family proteins (FIG. 2). These four homology motifs contain the catalytic and substrate-binding residues, and thus, are regarded as sequence fingerprints for the individual enzyme specificities in both GH70 and GH13 family enzymes. The order of the conserved regions I-IV in the L. fermentum GTFB is II-III-IV-I and corresponds to the order found in glucansucrases and GTFB-like 4,6-α-glucanotransferases, reflecting its circularly permuted domain organization. Motifs I-IV of the L. fermentum GTFB showed significant similarities with those corresponding to (putative) GTFB-like 4,6-α-glucanotransferases. First, the seven residues strictly conserved in motifs I-IV of GH70 family enzymes are present in the L. fermentum GTFB. Among these seven residues, the three putative catalytic residues Asp987, Glu1025 and Asp1097 (L. fermentum GTFB numbering), were identified as the nucleophile, the general acid/base catalyst and the transition state stabilizer, respectively. Similar to other GTFB-like enzymes, a Tyr residue replaces the subsite +1/+2 Trp residue (W1065 in L. reuteri GTF180 GS) conserved in all GSs, except for the branching sucrases. It is noteworthy that the conserved W1065 (GTF180 L. reuteri 180 numbering) is also substituted by a Tyr in the E. sibiricum GTFC and A. chroococcum GTFD 4,6-α-GTase enzymes. Thus, the presence of a Tyr residue at this position instead of the typical Trp residue represents one the main differences discriminating a GH70 protein active on starch/maltodextrin substrates from "classical" GSs. Also, *L. fermentum* GTFB contains Asp and Arg residues at positions 1028 and 1138 (GTF180 *L. reuteri* 180 numbering) contributing to the substrate-binding subsites+1 and +2, respectively, as is the case in most GTFB-like 4,6-α-GTases. However, the *L. fermentum* GTFB also shows unique variations in some of the residues contributing to the −1, +1, and +2 donor/acceptor binding subsites in motifs II and IV. Specifically, subsite+1 Asn residue (N1029 in *L. reuteri* GTF180 GS), which is highly conserved in glucansucrases and GTFB-like proteins, is replaced by an Asp in *L. fermentum* GTFB. In GSs, residue N1019 was found to be essential for activity and linkage specificity. Besides, the amino acids at positions 1137 and 1140 following the putative transition state stabilizer (GTF180 *L. reuteri* 180 numbering), are Ile and Asn, instead of the Gln and Lys residues present in most GTFB- and GTFC-like 4,6-α-GTases. Previous mutational studies revealed that these two residues contribute to glycosidic linkage specificity in GSs. In particular, the residue at position 1137 was found to be critical for the correct orientation of the sugar moiety at subsite +2. Despite the fact that the *L. fermentum* GTFB exhibits clear sequence similarity with the *L. reuteri* 121 GTFB 4,6-α-GTase protein, it contains unique sequence features in functionally important positions.

Purification and Biochemical Characterization of the *L. fermentum* GTFB

Figure 4:
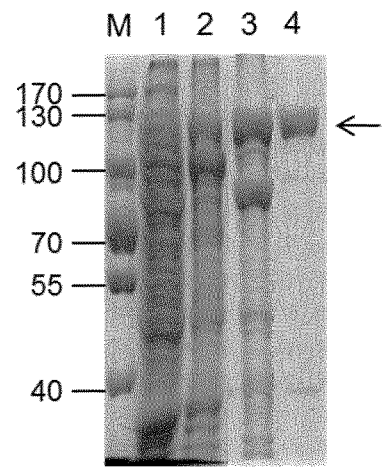
FIG. 4 shows an SDS-PAGE analysis of *L. fermentum* GTFB GH70 protein samples at different stages of purification. Lane M, molecular mass standards; lane 1, sample of *E. coli* cell free extract; lane 2, sample of the insoluble fraction after centrifugation of lysed cells; lane 3, pooled fractions after Ni-NTA agarose column chromatography; lane 4, purified GTFB 4,3-α-glucanotransferase after anion-exchange Hi-trap column chromatography. Bands corresponding to the *L. fermentum* GTFB protein are marked with an arrow.

The *L. fermentum* GTFB-ΔN protein was successfully expressed in *E. coli* BL21(DE3) Star. Under the growth and inductions conditions used, the expression level of GTFB-ΔN was relatively low in both the soluble and insoluble fractions (FIG. 4). The enzyme was purified from the soluble fraction by two chromatographic steps consisting of metal chelate chromatography and anion-exchange chromatography, as described in the Experimental Section. SDS-PAGE analysis of the purified enzyme revealed a single protein band with an apparent molecular mass of ~110 kDa (FIG. 4) which fits the theoretical value deduced from the sequence. As a result of this purification process, a total of 0.4 mg of pure GTFB-ΔN protein per L of *E. coli* culture was obtained.

Figure 5:
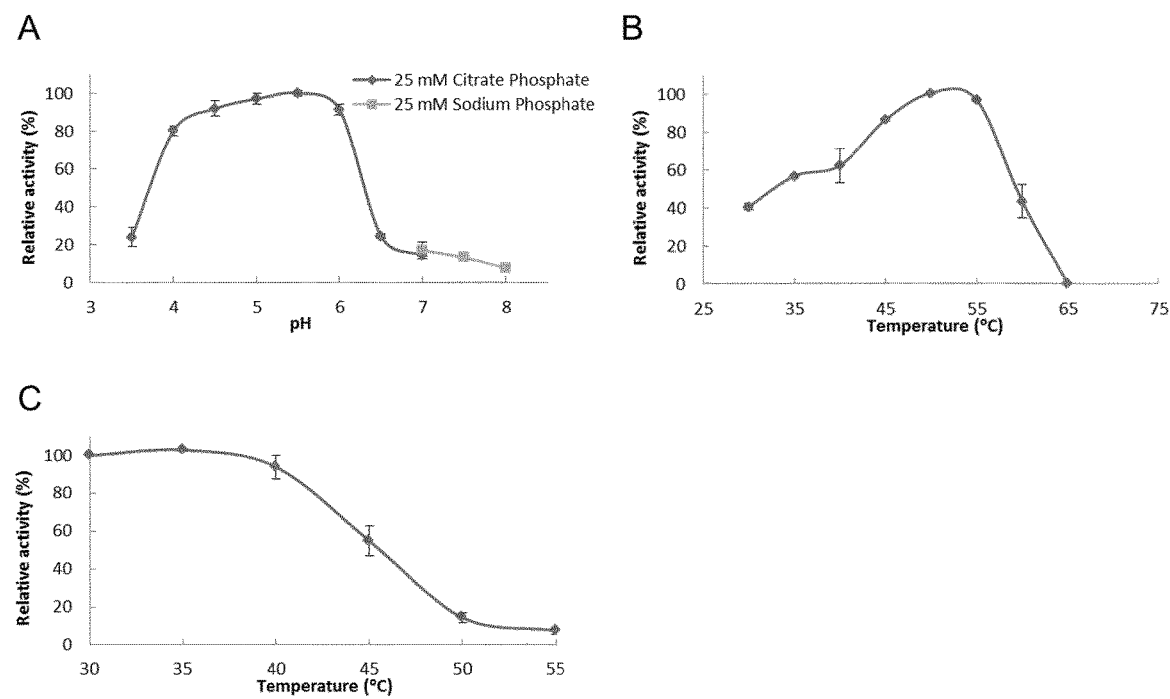
FIG. 5 is a series of graphs showing aspects of the biochemical properties of the purified *L. fermentum* GTFB enzyme. (A) Effect of pH on GTFB activity. Experiments were performed at 40° C. and the relative enzyme activity was compared with that at pH 5.5 (100% value). (B) Effect of temperature on GTFB activity. The assays were carried out at pH 5.5 and relative enzyme activity was compared with that at 50° C. (100% value). (C) Effect of temperature on GTFB stability. GTFB enzyme (0.1 mg ml$^{-1}$) was incubated for 10 min at the indicated temperature in 20 mM Tris-HCl pH 8.0 buffer containing 1 mM CaCl$_2$. Residual activity was assayed at 40° C. using amylose V as substrate under the standard conditions described in the experimental section. Experiments were performed in triplicate, and the bars indicate the standard error of three replicates.

The effects of pH and temperature on the enzyme activity were determined by the iodine-staining assay using amylose V as substrate. The purified recombinant *L. fermentum* GTFB exhibited the highest activity at pH 5.5 and retained more than 80% of this activity over a pH from 4 to 6 (FIG. 5A). The enzyme was active between 30 and 60° C., showing its maximal activity at 50° C., but the activity decreased drastically when the reaction was performed at 65° C. (FIG. 5B). In addition, the enzyme showed low stability at temperatures above 45° C. in 20 mM Tris-HCl buffer pH 8.0 (FIG. 5C). Similar pH and temperature optimum values were reported for the *L. reuteri* 121 GTFB 4,6-α-GTase enzyme. The specific total activity of the purified *L. fermentum* GTFB enzyme on 0.125% (w v$^{-1}$) amylose V in sodium acetate buffer pH 5.5, containing 1 mM CaCl$_2$ was calculated by iodine-staining assay as 22±0.36 U mg$^{-1}$ of protein. This value is around 10 times higher than the one reported for the GTFB from *L. reuteri* 121 (under its optimal conditions of pH 5.0 and 40° C.), namely, 2.8 U mg$^{-1}$ [Bai et al., 2015]. The activity of the *L. fermentum* GTFB was also assayed in the presence of the chelating agent EDTA at a final concentration of 10 mM, resulting in a slight (20%) inhibition.

Substrate and Product Specificity of the *L. fermentum* GTFB

Figure 6:
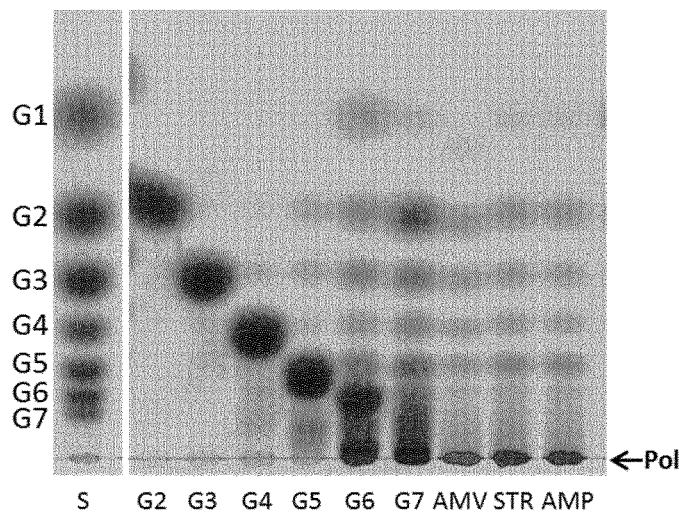
FIG. 6 shows a TLC analysis of the product mixtures synthesized by 25 μg ml$^{-1}$ of the *L. fermentum* GTFB enzyme in incubations with 25 mM malto-oligosaccharides (DP2-DP7), 0.6% (w v$^{-1}$) amylose V, 0.6% (w v$^{-1}$) potato soluble starch, and 0.6% (w v$^{-1}$) amylopectin. The reaction mixtures were incubated at 37° C. and pH 5.5 during 24 h. S, standard; G1, glucose; G2-G7, maltose to maltoheptaose; AMV, amylose V; STR, starch; AMP, amylopectin; Pol, polymer.

The differences observed in the homology motifs suggested that the *L. fermentum* GTFB may possess a new enzymatic reaction and/or product specificity. Therefore the *L. fermentum* GTFB enzyme was incubated with different oligosaccharides and polysaccharides at 37° C. for 24 h, and the reaction products were analysed by TLC (FIG. 6). Similar to *L. reuteri* GTFB, the *L. fermentum* GTFB enzyme failed to act on sucrose, panose, nigerose, and isomalto-oligosaccharides with DP2, DP3, and DP5 (Data not shown). Instead, the *L. fermentum* GTFB enzyme showed both hydrolysis and transglycosylase (disproportionation) activity on malto-oligosaccharides (MOS) of DP 6 and 7, evident from the accumulation of lower- and higher-molecular-mass products than the MOS substrates.

However, *L. fermentum* GTFB was not active on MOS of DP below 4 and showed low disproportionating activity with maltopentaose (DP5); in the case of the *L. reuteri* 121 GTFB activity was already observed with maltotriose (DP3). Incubation of amylose V, potato starch and amylopectin with the *L. fermentum* GTFB enzyme resulted in the appearance of a range of lower molecular mass products indicating that the enzyme was also active on these polymers. It should be noted that the *L. fermentum* GTFB enzyme produced significantly larger amounts of oligosaccharide products than the *L. reuteri* 121 GTFB, which mainly synthesized a (modified) polymer from amylose V. As observed by TLC, MOS of DP 2 to 5 accumulated from the various polymeric substrates, reflecting that *L. fermentum* GTFB requires maltohexaose or longer MOS as glucose donor substrates.

Figure 7:
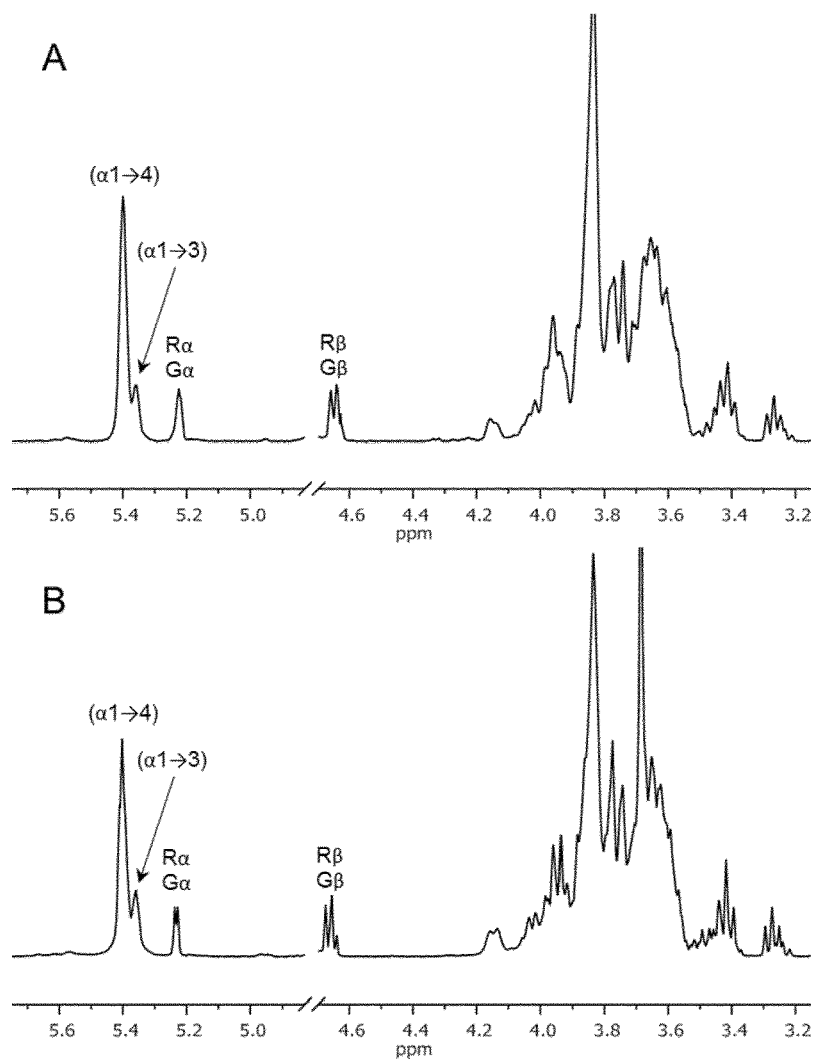
FIG. 7 is $^1$H NMR spectra (D$_2$O, 300K) of the product mixtures formed after incubation of 25 μg ml$^{-1}$ of *L. fermentum* GTFB enzyme with 25 mM maltoheptaose (DP7) (A) and 0.6% (w v$^{-1}$) amylose V (B) for 24 h at 37° C. and pH 5.5. The anomeric signals indicated as Gα/β and Rα/β correspond to free glucose and reducing –(1→4)-D-Glcp units, respectively. Chemical shifts are given in parts per million relative to the signal of internal acetone (δ 2.225).

Aiming to study the product specificity of the *L. fermentum* GTFB, the maltoheptaose and amylose V derived product mixtures were analyzed by one-dimensional $^1$H NMR spectroscopy (FIG. 7). The $^1$H-NMR spectra of both product mixtures revealed the presence of two groups of anomeric overlapping signals at δ ~5.40 and 5.35 corresponding to (α1→4) linkages and newly synthesized (α1→3) linkages. The presence of (α1→3) linkages was corroborated by the structural-reporter-group signal for (α1→3) linkages at δ$_{H-5}$ 4.16 ppm. The spectra also showed signals corresponding to free glucose units (Gα H-1, δ 5.225; Gβ H-1, δ 4.637) and 4-substituted reducing-end glucose residues (Rα H-1, δ 5.225; Rβ H-1, δ 4.652). Small signals corresponding to trace amounts (less than 1%) of (α1→6) linkages (H-1, δ~4.97) were detected. The molar ratios of the (α1→4)-linked, (α1→3)-linked glucose residues for maltoheptaose and amylose V products were 86:14 and 81:19, respectively. Methylation analysis of the product mixture generated by the *L. fermentum* GTFB from amylose V showed the presence of terminal, 3-substituted, 4-substituted, and 3,4-disubstituted glucopyranose residues in a molar percentage of 25, 16, 55, and 4%, which is in agreement with the linkage ratios determined by IId NMR and confirms that the *L. fermentum* GTFB exhibits (α1→3) linkage specificity. In contrast to the *L. reuteri* GTFB enzyme that only generates linear (α1→6) glucan chains (4,6-α-GTase), the *L. fermentum* GTFB acts as a 4,3-α-glucanotransferase (4,3-α-GTase) catalyzing the cleavage of (α1→4) linkages and the formation of new (α1→3) in linear or branched orientations.

Figure 8:
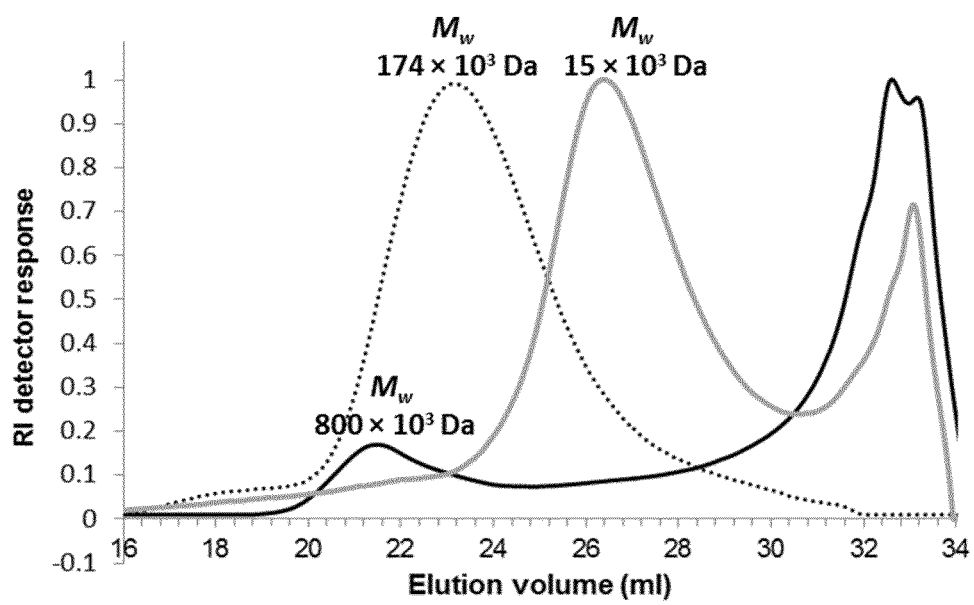
FIG. 8 shows the HPSEC molecular mass distribution of the reaction products generated after the incubation of 0.6% (w v$^{-1}$) amylose V with 25 μg ml$^{-1}$ of *L. fermentum* GTFB (pH 5.5) and *L. reuteri* 121 GTFB (pH 5.0) enzyme for 24 h at 37° C. The dashed line corresponds to the elution profile of the amylose V. The solid black and grey lines correspond to the elution profiles of products synthesized by *L. fermentum* and *L. reuteri* 121 GTFB enzymes, respectively.

The action of the *L. fermentum* GTFB enzyme on amylose was also characterized by HPSEC with multidetection (FIG. 8). The HPSEC profile of the starting amylose V substrate exhibited a single peak eluting at 23.0 ml, with an average M$_w$ of 174×10$^3$ Da, whereas *L. fermentum* GTFB-treated amylose V showed two different molecular mass distribution peaks: An early peak eluting at 21.5 ml corresponding to a high molecular mass polymer with an average M$_w$ of 800× 10$^3$ Da and, a second peak corresponding to oligosaccharides with an average M$_w$ of 1400 Da. In case of the *L. reuteri* 121 GTFB 4,6 α-GT, the peak corresponding to the IMMP eluted at 26.5 ml and had an average M$_w$ of 15×10$^3$ Da. Thus, the L. fermentum GTFB is capable of synthesizing a polymer with a $M_w$ value about 8 and 50 times higher than those of the starting amylose V substrate and the IMMP product, respectively. However, based on the refractive index signal this polymer represents less than 20% of the total product mixture, while a significant proportion of low molecular mass glucans are present in the product mixture of the L. fermentum GTFB.

Structural Characterization of the Products Synthesized by the L. fermentum GTFB from Amylose V For a more detailed structural characterization, the products produced by the L. fermentum GTFB from amylose were purified by size-exclusion chromatography on Biogel P2. The seven fractions obtained, designated as F1-F7, were analyzed separately by MALDI-TOF MS and $^1$H NMR spectroscopy (Table 2). Fractions F6 and F7 contained the hydrolysis products maltotriose (DP3) and maltose (DP2), respectively, and were not further studied. The 1D $^1$H NMR spectrum (FIG. 7) showed α-anomeric signals at δ 5.41 and 5.37; this region may contain anomeric signals of both (α1→4) and (α1→3) linked α-D-Glcp residues. Therefore, fractions F1-F5 were also subjected to methylation analysis in order to determine the presence of (α1→4) and (α1→3) linkages and to determine the degree of branching. The methylation analysis data fit with the peak at δ 5.37 corresponding to (α1→3)-linked residues (Table 2). The $^1$H NMR and methylation analysis of the Biogel P2 fractions demonstrated that the percentage of (α1→3) linkages increased with increasing DP of the products (Table 2). The highest molecular mass product F1 containing polymeric material of DP >30 showed an increased percentage of →3)G1cp (1→glucosyl units (28%) and branching →3,4)G1cp (1→glucosyl units (8%) over those in the total reaction product mixture, 16 and 4%, respectively.

TOCSY spectra with 60 ms (not shown) and 150 ms (FIG. 9) mixing time allowed for elucidation of three H-3 signals at δ 3.70, 3.85 and 3.97, and H-4 signals at δ 3.65-3.67 and 3.42, respectively. In case of a terminal α-D-Glcp-(1→4)-residue H-2, H-3 and H-4 signals are expected at δ 3.57, 3.71 and 3.42, respectively, for a (1→4)-α-D-Glcp-(1→4)-residue H-2, H-3 and H-4 are expected at δ 3.63, 3.96 and 3.65, respectively, whereas a (1→3)-α-D-Glcp-(1→4)-residue should render H-2, H-3 and H-4 at δ 3.68, 3.85 and 3.65, respectively. The 2D $^{13}$C-$^1$H HSQC spectrum showed the $^{13}$C chemical shifts, correlating with the $^1$H chemical shifts expected for these residues. Most notably the 4-substituted C-4 value at δ 78.8, correlated with H-4 at δ 3.65, and C-3 at δ 80.4, correlating with H-3 at δ 3.85 ppm. The data observed in the 2D NMR spectra fit with the occurrence of these three types of residues.

In the δ 5.37 anomeric track the 2D $^1$H-$^1$H COSY spectrum (FIG. 9) showed H2 signals at δ 3.57 and 3.61, indicating the presence of at least two types of residue. The 2D $^1$H-$^1$H TOCSY spectra revealed H-3 signals at δ 3.75 and 4.03, H-4 signals at δ 3.67 and 3.43, and an H-5 signal at δ 4.16, respectively. The signals for H-2-H-4 at δ 3.57, 3.75, 3.43, respectively correspond with those expected for a terminal α-D-Glcp-(1→3)-unit. The H-5 signal for this unit is expected at δ 4.02, which overlaps with the strong H-3 signal at that same chemical shift. The 2D $^{13}$C-$^1$H HSQC spectrum (FIG. 9) shows a C-5 (δ 72.4) and a C-3 value (δ 74.3) correlating with the $^1$H chemical shift at δ 4.02, indicating the occurrence with H-5 at δ 4.02 as expected for the terminal α-D-Glcp-(1→3)-residue. The remaining combination of δ 3.61, 4.03, 3.67 and 4.16 for H-2-H-5 are in line with a -(1→4)-α-D-Glcp-(1→3)-residue. The 2D $^{13}$C-$^1$H HSQC spectrum (FIG. 9) confirms the assignment of the $^1$H chemical shifts, showing unsubstituted C-4 values δ

TABLE 2

Linkage composition of the fractions (F1-F7) yielded by size-exclusion chromatography on Biogel P2 of the product mixture obtained from the incubation of 0.6% (w v$^{-1}$) amylose V with 25 μg ml$^{-1}$ of L. fermentum GTFB.

| | | Chemical shift (%) $^a$ | | Methylation analysis (%) $^b$ | | | |
|---|---|---|---|---|---|---|---|
| Sample | DP | (α1→4) | (α1→3) | Glcp(1→ | 3)-Glcp-(1→ | →4)-Glcp-(1→ | →3,4)-Glcp-(1→ |
| F1 | >30 | 60 | 40 | 6 | 28 | 58 | 8 |
| F2 | ~8-20 | 71 | 29 | 12 | 21 | 61 | 6 |
| F3 | ~6-8 | 80 | 20 | 14 | 15 | 66 | 5 |
| F4 | ~5-6 | 88 | 12 | 21 | 10 | 67 | 2 |
| F5 | ~4-5 | 89 | 11 | 21 | 10 | 64 | 5 |
| F6 | ~3 | 100 | 0 | ND | ND | ND | ND |
| F7 | ~2 | 100 | 0 | ND | ND | ND | ND |

$^a$ The data represent the ratios of integration of the peak areas of the (α1→4) linkage signal at 5.41 ppm and the (α1→3) linkage signal at 5.37 ppm in the $^1$H NMR spectra.
$^b$ The linkage distribution data are shown in molar percentages based on GLC intensities.

Figure 9:
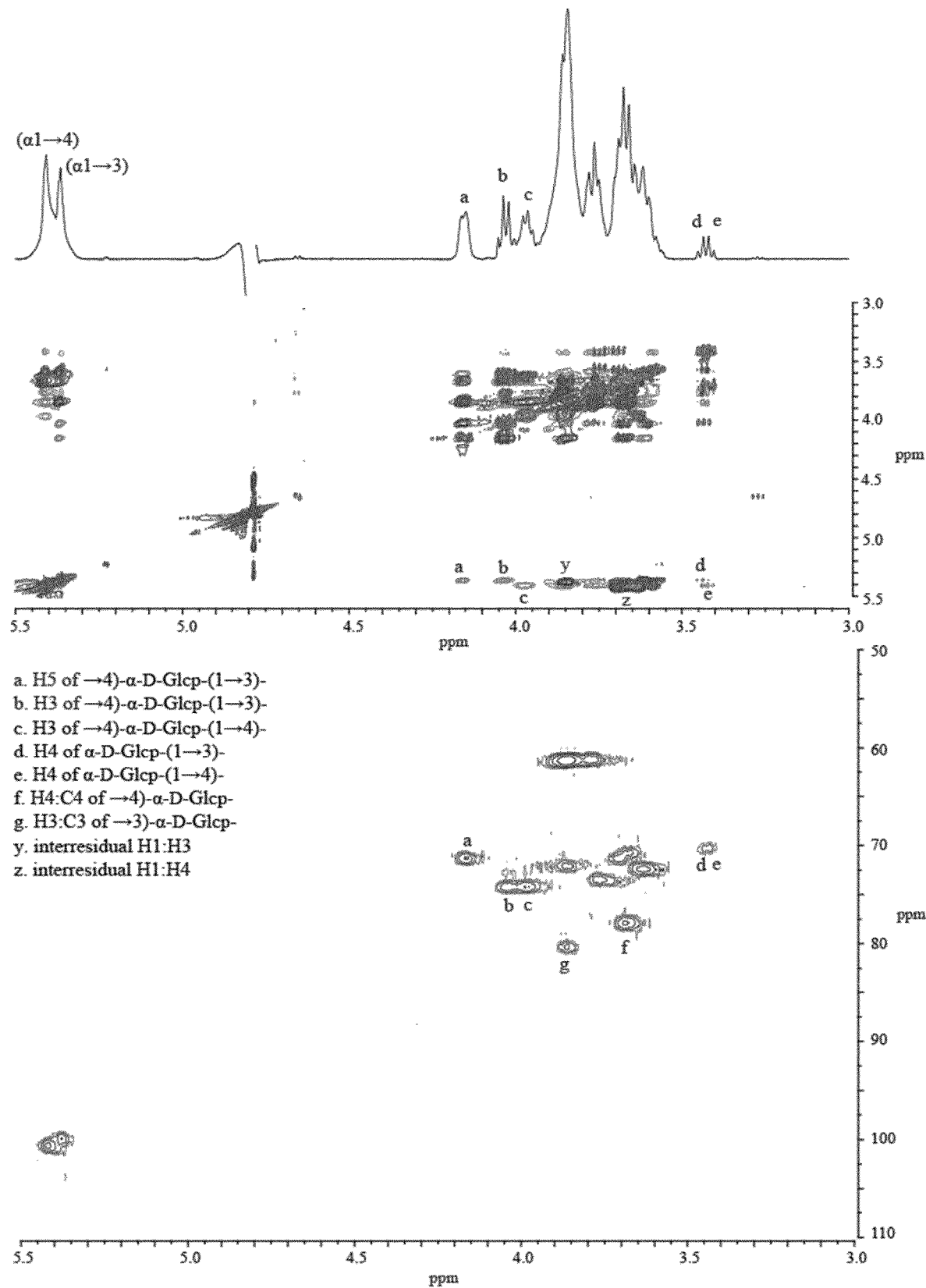
FIG. 9 is a 500-MHz 1D 1HNMR spectrum, 2D $^1$H-$^1$H COSY, TOCSY spectra (mixing time 150 ms), ROESY and 2 D $^{13}$C-$^1$H HSQC spectrum of the Bio-Gel P-2 polysaccharide fraction F1, obtained after 24 h incubation of 0.6%

To unravel the structural elements present in fraction F1, 2D NMR ($^{13}$C-$^1$H HSQC, $^1$H-$^1$H TOCSY, and $^1$H-$^1$H ROESY) experiments were performed (FIG. 9).

Structural Analysis of the Polymeric Fraction F1

The 1D $^1$H NMR spectrum (FIG. 9) of the polysaccharide product (F1) showed sharp anomeric signals at δ 5.41 and δ 5.37 ppm, fitting the presence of (α1→4) and (α1→3) linked glucose units, respectively, in a 6:4 ratio, fitting with the methylation analysis data (Table 2). Table 3 summarizes the NMR data.

In the δ 5.41 anomeric track at least three overlapping types of residues were observed, as evident from the H2 signals in the 2D $^1$H-$^1$H COSY spectrum (FIG. 9) at δ 3.59, 3.63 and 3.69, respectively. Further analysis in the 2D 71.2, correlating with H-4 at δ 3.65, fitting with the 4-substituted α-D-Glcp-(1→3)-residue. Although no distinct signals were found for 3,4-disubstituted residues, there is a significant amount of terminal residues observed as indicated by the structural-reporter signals at δ 3.42 and 3.43 ppm, representing 8.4% in relation to the anomeric signals. Since only (α1→4) and (α1→3) anomeric signals are observed, the branched residues have to be 3,4-disubstituted. This is further supported by the methylation analysis data (Table 2) indicating approximately 8% 3,4-disubstituted residues in F1.

Notably, the (α1→3)-anomeric track showed no H-3 signals at δ 3.85, whereas the 2D $^{13}$C-$^1$H HSQC spectrum showed only 3-substituted C-3 (δ 80.4) correlating with H-3 at δ 3.85, and the 2D $^1$H-$^1$H ROESY spectrum (FIG. 9, red) showed inter-residual correlations between the (α1→3)-anomeric signal only with H-3 at δ 3.85, indicating that no sequential (α→3)-linkages occur. Moreover, the 4-substituted C-4:H-4 signal is only observed at δ 78.8:3.65-3.67 ppm.

TABLE 3

$^1$H and $^{13}$C chemical shifts determined from 1D and 2D NMR spectroscopy for *L. fermentum* GTFB polymer product fraction F1.

| | A | | B | | C | | D | | E | | F | |
|---|---|---|---|---|---|---|---|---|---|---|---|---|
| | $^1$H | $^{13}$C | $^1$H | $^{13}$C | $^1$H | $^{13}$C | $^1$H | $^{13}$C | $^1$H | $^{13}$C | $^1$H | $^{13}$C |
| 1 | 5.41 | 100.6 | 5.41 | 100.6 | 5.37 | 100.0 | 5.41 | 100.6 | 5.41 | 100.6 | 537 | 100.0 |
| 2 | 3.63 | 72.3 | 3.69 | 71.3 | 3.61 | 72.3 | 3.69 | 71.3 | 3.59 | 72.3 | 3.57 | 72.3 |
| 3 | 3.97 | 74.2 | 3.85 | 80.4 | 4.03 | 74.2 | 3.85 | 80.4 | 3.70 | 73.5 | 3.75 | 73.5 |
| 4 | 3.65 | 77.8 | 3.66 | 71.3 | 3.67 | 77.8 | 3.66 | 77.8 | 3.42 | 70.3 | 3.43 | 70.3 |
| 5 | 3.85 | 72.0 | 3.75 | 73.5 | 4.16 | 71.3 | 3.85 | 72.0 | 3.75 | 73.5 | 4.02 | 72.9 |
| 6a | 3.87 | 61.3 | 3.87 | 61.3 | 3.87 | 61.3 | 3.87 | 61.3 | 3.87 | 61.3 | 3.87 | 61.3 |
| 6b | 3.77 | | 3.77 | | 3.77 | | 3.77 | | 3.77 | | 3.77 | |

Smith Degradation Analysis

In order to confirm the absence of consecutive (α→3)-linkages a sample of F1 was subjected to Smith degradation with NaIO$_4$ under mildly acidic conditions, followed by reduction with NaBH$_4$ and mild hydrolysis with formic acid. Considering the linkage analysis, fragments of [α-D-Glcp-(1→3)-]$_n$α-D-Glcp-(142)-L-erythritol are to be expected, and due to over-hydrolysis erythritol and [α-D-Glcp-(1→3)-]$_n$D-Glcp fragments. HPAEC-PAD analysis showed fragment peaks between 2 and 6 min elution time. Since fragments of [α-D-Glcp-(1→3)-]$_n$α-D-Glcp-(1→2)-L-erythritol and [α-D-Glcp-(1→3)-]$_n$D Glcp with n≥1 are expected at retention times above 10 min these results support the suggested absence of consecutive (α1→3)-linkages.

Constructing a Composite Model for F1

The structural reporter signals at δ 3.43 and 3.42, for α-D-Glcp-(1→3)- and α-D-Glcp-(1→4)-residues, respectively in the 1D $^1$H NMR spectrum of F1 indicate 8.4% branching to occur. The relative intensities of the two distinctive peaks are equal, indicating 4.2% α-D-Glcp-(1→3)-residues and 4.2% α-D-Glcp-(1→4)-residues. Taking into account that there are no consecutive (α1→3)-linked residues, all 3-substituted residues must be (α1→4)-linked. Also the branched residues are (1→3,4)-α-D-Glcp-(1→4)-residues, amounting to 8.4%. Since 40% (α1→3) linkages are observed 31.6% of the residues have to be –(1→3)-α-D-Glcp-(1→4)-residues. Since 4.2% of (α1→3)-linked residues are terminal, there are 35.8%–(1→4)-α-D-Glcp-(1→3)-residues. This leaves 15.8%–(1→4)-α-D-Glcp-(1→4)-residues. Taking together all data from 1D and 2D NMR spectroscopy analysis, methylation analysis and Smith Degradation analysis, a composite model for F1 was constructed, showing all identified structural elements in the correct relative abundance (FIG. 10).

Oligosaccharides Formed in Time from Maltoheptaose and Amylose V by the *L. fermentum* GTFB Enzyme To gain a better understanding of the action pattern of the *L. fermentum* GTFB enzyme, time course experiments were performed with the maltoheptaose and amylose V substrates. The oligosaccharide products formed after 10 min, 1 h and 24 h of reaction were analyzed by HPAEC. At the early stage of the reaction with maltoheptaose (slightly contaminated with G6 and G5), G2 was identified as the main reaction product (FIG. 11A). Small peaks corresponding to glucose (G1) and maltotriose (G3) were also identified, whereas a peak with an unknown structure but with a high DP eluted at 58 min. The release of G2, together with the synthesis of a compound with a higher DP, suggests that the *L. fermentum* GTFB enzyme catalyzes the transfer of a maltopentaosyl unit to a MOS acceptor substrate. Later in time, the amounts of glucose and MOS with DP2 to 5 increased, whereas after 24 h G6 and G7 had become depleted. In addition, as a result of the *L. fermentum* GTFB disproportionating activity, peaks that did not fit the MOS retention times and probably corresponding to oligosaccharides containing (1→3) linkages, were detected at shorter and longer retention times than that of the G7 starting substrate. Incubation with the amylose V yielded G2 as the first clear reaction product, together with G1, G3, G4, G5 (FIG. 12A). These profiles significantly differed from the ones obtained with the *L. reuteri* 121 GTFB enzyme when both G7 and amylose V are used as substrates (FIGS. 11B and 12B). With both substrates the *L. reuteri* 121 GTFB releases glucose (instead of G2) as the main first product at the beginning of the reaction. The pronounced accumulation of MOS with DP2 to DP5 by the *L. fermentum* GTFB was not seen for the *L. reuteri* 121 GTFB. These results suggest that the *L. fermentum* and *L. reuteri* 121 GTFB enzymes differ in their mechanism of polymerization. The novel *L. fermentum* GTFB enzyme preferentially catalyzes the transfer of MOS of low DP, showing a mode of action more resembling that of the *A. chroococcum* GTFD enzyme. On the other hand, the *L. fermentum* GTFB 4,3-α-GT seems to require MOS of a certain minimum length (at least DP6) to act on and to produce an α-glucan with an α(1→3)/(1→4) alternating structure and with α(1→3) branching points. Finally, the data indicate that the *L. fermentum* GTFB 4,3-α-GT may present more than one donor binding subsite, as observed in the case of enzymes belonging to the evolutionary related GH13 and GH77 families.

Enzymatic Treatment of the *L. fermentum* GTFB Product

To further characterize the polymer synthesized by the *L. fermentum* GTFB enzyme (Biogel P2 fraction F1), this α-glucan was treated with a high activity dose of α-amylase, dextranase and pullulanase enzymes. The polymer produced by *L. fermentum* GTFB was resistant to the endo-(1→4)-hydrolase activity of α-amylase. As revealed by TLC analysis, only trace amounts of glucose, maltose and high molecular mass oligosaccharides were detected after 48 h of αα-amylase digestion (FIG. 13). Under the same reaction conditions, the starch control substrate was completely hydrolyzed, indicating that the presence of α-(1→3) linkages makes the *L. fermentum* GTFB polymer resistant to α-amylase digestion. The *L. fermentum* GTFB polymer was also subjected to dextranase and pullulanase enzymatic treatments. Dextranase catalyzes the endohydrolysis of consecutive (1→6) linkages in dextran, while pullulanase cleaves the (1→6) linkages present in pullulan, amylopectin and α- and β-limit dextrins of starch. Thus, for the dextranase and the pullulanase treatments, the polymers produced from amylose V by the L. reuteri GTFB and the A. chroococcum GTFD were included as positive controls, respectively. As expected, dextranase efficiently hydrolyzed the IMMP produced by the L. reuteri 121 GTFB, whereas pullulanase completely digested the reuteran-like polymer synthesized by the A. chroococcum GTFD enzyme. In contrast, no hydrolysis was observed in the case of the L. fermentum GTFB polymer, which is in agreement with the absence of (1→6) linkages (less than 1%) deduced from the $^1$H NMR analysis.

CONCLUSIONS

This work has identified and characterized the first GH70 enzyme cleaving (α1→4)-linkages and synthesizing (α1→3)-linkages, encoded by L. fermentum NCC 2970. The inventors propose to name this enzyme (α1→4)-α-D-glucan: (α1→4), (α1→3)-α-D-glucan α-glucanotransferase, in short 4,3-α-glucanotransferase. Regarding its primary sequence, this protein clearly belongs to the novel GTFB-like GH70 subfamily which originally only comprised 4,6-α-glucanotransferases, however, it also possesses unique variations in residues forming the acceptor binding subsites of GSs suggesting that its active site display distinctive features. In accordance with these findings, the L. fermentum GTFB resembles previously characterized GTFB enzymes in using maltodextrins and starch as substrates, but instead of catalyzing the synthesis of consecutive (α1→6) linkages, it displays an (α1→3) linkage specificity. The L. fermentum activity results in the synthesis of an unique α-glucan built up with different lengths of malto-oligosaccharides, interconnected by single (α1→3) linkages in linear and branched orientations.

Even though GSs have a wide product spectrum and synthesize various types of linkages, none of the GSs characterized so far produce an α-glucan consisting of (α1→4)- and (α1→3)-linkages. The structure of the L. fermentum GTFB product also differs from that corresponding to α-glucans containing both (α1→4)- and (α1→3)-linkages found in different lichens and fungi. Indeed, most of these polysaccharides have linear structures, whereas others are mainly composed of (α1→3)-linkages and/or do not present (α1→3,4)-branching points. The direct action of the L. fermentum GTFB on the starch present in food matrices provides starch derivatives which have structural features consistent with low digestibility.

SEQUENCE LISTING (85 sequences)

SEQ ID NO: 1 - protein, 1593 aa, Lactobacillus fermentum
  CNCM I-5068
  NCC 2970 GTFB
MEFKKHFKLYKSGKQWCIAAVVTFTATLGLVAGNTTVNADTLTTGGSTPQAQVNQEKGITNTSQPASDQGKTSNTGDVRNTVPQPNNSDKTNQYQADTLTTGGSTPQAQVNQEKGITNTSQPASDQGKTSNTGDVRNTVPQPNNSGKTNQSQNGQDQKESAGNDNGSTGNNDQNKGQQTTDWQKNANNQWVYNGKTDQDLKGTQYVQLPTIPDTNVQGNTNWYFVKDGIAQSGVQQWAGTYYYFDPTTYLRVDNDYRQSQWGDWYLFGNDGRILSGVQQWAGTYYYFDPTTYLRVDDDYVTSQWGLKYMFGKDGRIATGLYKWDKNNQWYYFNPTTYLAVTNNYIQANDGHWYLFTADGTAASRVAKWAGTYYYFDPQTHLRVDDNYVQSQWGDWYMFGKDGRIATGLYKWDKNNQWYYFDPTTYLAVTNNYIQANDGHWYLFTADGTAASRVAKWAGTYYYFDPVTHLRVDNNYVQSQWGDWYLFGNDGRILSGVQQWAGTYYYFDPTTYLRVDDDYVTSQWGLKYMFGKDGRIATGLYKWDKNNQWYYFDPTTYLAVTNNYIQANDGHWYLFTADGTAASRVAKWAGTYYYFDPQTHLRVDDNYVQSQWGDWYMFGKDGRIATGLYKWDKNNQWYYFDPVTYLKVTNKWVDGNYYDEDGAQAISKLVTINNRLYYFDDQGKEISNQFRTIHGDKYYFGNDSAAVTGQQTIDGKVYKFSNYGYLLGNRYGKIENGKLNIYSLADHSLIKTVEAGPWENMAYSMDSNSINNIDGYISYTGWYRPYGTSQDGKTWYPTTVADWRPILMYVWPSKDVQVKFIQYFVNHGYENSNYGLTAGSVKDLSENTASINLNEVAQNLRYVIEQHIVAAKSTSQLANDINNFITTIPELSASSELPDESGSGQVIFVNNDNTSYADSKYRLMNRTVNNQTGNDNSDYCPEFVVGNDIDNSNPVVQAENLNWEYFLLNYGKLMGYNQDGNFDGFRIDAADDMDADVLDQIGQLMNDMYHMKGNPQNANNHLSYNEGYGPGAARMLNKKGNPQLFMDARECNTLENVLGRANNRDTISHLVTDSIVNRQNDVTENEATPNWSYVTNHDIRNNLINGLIIKDHPGMGSAYKAEYANQAWQEFYADQKKTDKQYAQYNVPAQYAILLSNKDTVPQIYYGDLYNETAQYMQEKSIYYDAITTLMKARKQFVSGGQTMTKLSDNLIASVRYGKGVANANSEGTDSLSRTSGMAVIVGNNPQMAEQTISINMGRAHANEQYRNLLDTTDNGLTYNADGAENPETLTTDDNGILKVTVKGYSNPYVSGYLGVWVPVASGNQDVTTNAATVSADSNKIFESNAALDSHMIYEDFSMYQPKPTSTENHAYNIIAQNAELFNNLGITDFWMAPAYTQAGTSRYNEGYSVADRYNLGTNANPTKYGSGEELANAIAALHSAGLKVQEDIVMNQMIGLPGQEAVTVTRADNRGMQTYVNGKTYANQMYFAYTTGGGNGQETYGGKYLSELQSKYPDLFTTRAISTGVAPDPTTHITKWSAKYENGTSLQNIGIGLAVKLANGDYAYLNDSNNKAFNTTLPETMSSTDYYANIEDN

SEQ ID NO: 2 - DNA, 1949874 bp, Lactobacillus fermentum
  CNCM I-5068
  genomic DNA; Lactobacillus fermentum CNCM I-5068
gggcgtcttcgcgacgggaattcttcaagtattgaccggctcgctttgaatcgccaaggatttgccggtaattaggaataatctgggcggtgttgatctccatttcgcgatcaaagtcgtgctcctcaagtgagttaatgaagctagcgaagcggtcgttggccacctgctcttcttgcagggcttcatcgaaatcgtagtagttgagcatcgccaaaaaacagaggcggaaataactacgggtttcctcgtccattggcggcagcgttaaaaagaggctggtgtagctagcgccggctaagaaccgctcaatgtaatcggcgtaatcacggcgttcccggttggttaaatacccactctcttcttcgccccagtaatcgtcaaaggcaatcacggcggccactaaaaagtcgtcgacggccattcgccactccggccggctatccccgctctctaaaaaggcaaaggcccggttgccaaaggactcggcgtttggccagagggcgatggcgtccgtaaagtacttgatcgctaagtggagatgtccatcaacgacggcctcctccccctgtcggttgtagcgcatggcaagtgtttgattgtagctagccatttcaaggcccccttcattggaattattatggttcattttactctctttaccaaggaagcaccaaatttcggtttaaagctaattccatggggcgaattgtcaaactaagtgcaacggtttgtcaaaaaatacttcatatggggtttcatagtttaacactttgcgaggacgttgatttaactgcttttggcagtgttcaacgtcctgttctgtataattatcaatatctgttcgcttgggaaaatattcccggattaatccatttgtattctcatttgttccacgctgttcaggcgaatatggatcgggccaatagacagtaatacctaacctttcgctgatttcatcaagatgaagaaattcggtcccatgatctggtgtaatagaatgaacaaattctttaggaatggcccctaacagttcaactaagcctttatttatctcctgcgagtccttttgcataacctttttgataagcgtaagccgactaagccgatcgacaaccgttaaaaggatggagtgacccgttcgaccaatcacagtatcaatttcccagtcacctatacgttgacgctggttgataaaaccagggcgctcatggatcgagatatagtcggtctgtacttctcgatgtcgtctagtattctttgaatgccgggtccgatgtttatgtctgagatggcgctgaataccggtatcaccacgtgaggagtacttttcacctaaattgtgttgatagatatgacggtaaattgtgttgtagctaacacaccattgatgttccttattaaagcgagcggtaatctgctctggtgaccagtgcagatctaagatgtaatgaacaatttgacggcgtaattgtggatggctgtctaatagccgcttcttgtgacaattctgccgcttttgatgatagtcattatctgctttgcttggggaataattacctgcacaacgttttaactcccgtgaaatagtgcttggatttcgccccagccgtaacgcgacagcccggatagataaccccttagctcgtaaaaacataagtatttcacgttcttttatagtaagatgtttatagctcataccggatacctcgaattgtttaatttggtcgttaaacatattctacccggtatgggtttatttttttactttgtgttgcatttcaattgtaaattcgccgcacaaaaaaaagaacgccccttcggacgtccctggttagttggtcagctgttgctggcggatttggatccattcttcaaattgacgaaggtcctgttcatttgccgatttaaggataaggttcttcccccgactcttgtattgaatccgacgaacaacatctgggttcttcttttggtagcgcacgttggcacgcttttgggcttcgcttatcgacatgtaaattcaccgccagtctatatgtaatcgtacatgataattatcggtgtgaagatcaagattcccaatccactaaatcaaagtggataaaaatacggtcaaagggtgaattatcagtagtatatgaggagacttgaataaccttcatcccgacccctttgactatatttattttacacccgatagacaagatagatcgaatagattttcaaataagaaaaatacgtttatttataagcacacaaaaaccggctttccccgccgttgccgggtaaaaagtcggttgagtaacgaaaattttgattttattttacgccttgtttaacaagtgacctgtcactcgttcgataacggtggcggggttttcaacactcaaaatcaaccggtcgtagccttcgtttatcagcgttataacaacgatcggggtattacggcgtacgttatagaagcggcgttgaccgtcataaaaaaagctaccggcgtagtataaaccaggaattgcggttccgggcaagcgcaaacctttgtgctcctcaaaggccccctgatcacgaaagataccggtcacgtgcctccaaggcacccgaatggctcccttcagcgcccagaggcggtcgagaccggccggggaaacgaccagttcggttggcgtaatggtaatttggttgtacattgagcatctctccttatcgatcactacttaaatggactaatgtaagggcaactttcattatcaaaggttatggttagtgcttggcaaggtgcaaaagatccaagattcgtttgagtggcagcgactgaatcagggtgcacaggatgatcaataatgaacccaagacgctcgccgccgtcaacttggttcccaagaaagccaccgctaaggttgtggcgaccaatggttcaaaggccgacaacatcccggtgacggctggtgaaatgtaattaatgctgctcaaaaagagggtgtaggccaggatcgttccgaatataacgatgtagacaagggtttcccaatcgaaggccgtcatattgggtaagggcgtaaggaccaaaactgggctcatgcaaatccccccgatcagcattcctaggccgcagacggttagcgtgtcgtagcgacttaacaggccctggggtaagacggtgtagatggcggccgccagcgcacacattaacccccaaaacagggcgatcggcgtcagggatagcgagttcaagtgtccgccggtgaccaaaaagaaggtccccaccagagcaattgtaatcgaaagtatgtctagccgcctgggccaggcccggttacgaagggtaaaccagacaatgattaacaccggttgtaagtactgaatcaccgtggcggtcggggcgttgctcgtttgtaccgccttcatataggtaaactgggagttcagcatccccaaaaaggtaaatgcaattaaaatccctaggtcgcccctattagttaagagccccttgatttgccccgggttgcgcaccaaaccgattgccgtcatgattaagccggcaaagatcaggcggacggccactaaccaggatgcggtcattgacgtgtgtgaaaagattagctgggcgccagctcccgaggccccccacagggacgctccgcaaatggccaggaggatccccttgtttgattttgtcattcaatcccctctcttcttctaaagtgttaaccctaaatatagcagtcgccaaaagaaatgaacaacccccctcgccaaataaaataggggtggaagcggtttatcaaaccctttataatatagatagaaaatctagatcgaagaatgcggggtccgttaaccaatgggggttggttaaatgggtgcacccctacgtccaattactgatcgacgttaaaagctgctattcgggaggaagcctcatggcaagaaaaattaaggatgataacggtcacgtgtacgtagaaaagaagcccttttataaacgggtctggttctggttagtggtcgtggtgttagtggtgattgtcgccgcggggatgggtggctccggttcatcggatagctcagataagtccgcctcgagctcgagcagttcggccaccccactcgataaggtgtacaaggtcggccaaaccgcctcgtataagggttataagattaaggtcaatagcgtttcgtacagttccggtaacgagtacgaacagcccgattccggtaagcaatacgtgattgtcaacgtgacgatcaccaacgataccgacgaatcgcaagactacaacccttatgactttaagctcaacgccgacgggaataacaccgacctcgatgaaatctacaccgacgtcgacaacaccttaaacgccggttccttagacaagggggcctcggtgaccggtaacatggtcggccaggcaagcacgagcgtctctaagctccagctccaataccagacctcggtttggaacaataagacggttaagtttgatttgaagagtaatcagtagaaaaaagatcccgggaataacgactttcccaggatcttttttatttcggttttttacgacagggagctttagagactgcacaaatgtttagatttgtcctgtccccctagccgttttcttgtgcggcggtatcggcggccaagcggccaaaggtaaagatatcagccaacgagttaccaccgagccggttcccagcgtggaggcccccggcgttttccccggcggagtataaaccggcgattacttgctccgccttgtctagcacgtgaccgtgttcatcaatcgccaagccccccatcgtgtggtggatggccggcttgcgcggggtggcgtaaaatggcgccacttcgcacttaaggtggaaggcactcttgccaaactccggatcgtggcccgcgtcgacgtaagaattgtacttgttaatcgtgtcttccagggtggccgggtccatccccaccttcccggctagttccgctaacgtatccgccttaaagagggtgccggcttcgacttgggcgtcaattgattcctgggtcgtgttgtaggccgtctctttgatcttatcatcggcaatcaagtagaagaggcccccctgggcaatcgcggcggcggccagggtgtcgcgttccgcaaactcgttgacgaaccgcttgccctcttggttgaccatgatgaagttttccggtggcgtctgcaggccggtaaacagttccccggtcaccgggtcggagactggcattaactggataaagcccatcccggtcaactcggcgcctgcctcctggcctaaactaatcccgtcaccggtgatggccggtgaattagtggtggcgatgtcgtcgtcaatgtgctcccagtaggtgttgtacttttggaccattggcgtgttggcgccaaagcccccggcggtcaagaaggtggatttagcacggacggtcaccttagtcccgtcggtcttgtgggccacgacccccactacccggccgttttccatcaggaggtgttcggcacgggtttcggttaggatggtggcaccgtgttccgtaacccagtcgcccaggacgtgaatgaaggcgtaccccattggctcaaccggcttgtggccacgccgccacagggccccaaccggcattgttacgtcggtttgatcgaatttaaccccaaggtcagctagccatttgaccgagtccagagcgttatcgaccaaggtcttgaccagctggtaccgaccgtgaatttcatgaccggcgaggtcttcacgcttcccccctaggtaagtctggatttcgtgaaggaggttggaatcaaagaggtactgggctccggaagcaatgtattccttaatttgctcccgtaaccgttcaaagtcggcacggtattcggggtcgatctgttctaatggcatgttagccaactgtttcagggtctctttttccccggtcaaggcggcaaagtccctttgccagtccggatcagcggcgttcattggtcccccggcccgggtggtgttgccccctagttgcgggaacttttctaaaataacaacttgcttatcgtgctggaggctccgggtagcggccgccaagccagccccaccggccccaactaccaccacgtcggtttgatattcctcaacttgagcggcctgagtcgctgcttctggcttggcccgttgcttccactcagcggcatcgccaccggccagggtaatcgcttcggccaccccgtcaacgaccccacgtgaggagattgtcgccccggcaacggtgtccacgtttagcgtttgtcccttcacaatcttagccggaagccgtttaaaaacttcgtcggcgatcccgcttgtttccccactggcgtcaactcgaatccgttgaatcgcatcgtcgcttagcgtgacctccattggcatgaaggatgagccgtgccccttagcttttactttgtacgttcctgctttcattgttcatcgctcccttgtgaaatcaatctcatgttcgagtaaattgtagcgcttccgaacggaaatgggaacgacctgtgttattattggatcataactaaaatattatcgaaaggatggttaacgtgcgtgacccggatttgatgctcaactacttagaggtcttgcttaagcacagcaacttcactaaggcggctagcgagctttacatctcccagccctatttgacccagctaatcaaacggatcgaaaaggaattgggcgccccaattatcaaccgccaccgcttacccttctctttaacggaagccggccaaatatactaccagtacctcgagaacctgtcagccgaacatcaacgccttgcacttcaattagcccgctacaccaacgacagcaccaaaatcatccgggtggccgttttagagagcctgggaaccttcttgttgccggcaatcctcccccgcttcttaaaggaccaccccagcgtccggatccaagtggtcgaaggcttcccccaccaaagcgaggagcggattttaaatgaccaggccgacctttacatgggccaaacccccgaaaccttaaattacgggattcacccctacattaacggcggcgagaactactacgtcatcatccccgccacctccaagttttaccaacccggtcgcttcatcctcgacccttcaacgtacaacctagacgacctcttgcaagaacccttcgtcttgagttctgccgaatcggaaattcgccaccaggttaacagcctctttcaaaaccggaagctggttcccaaggtagtgatggtctcaaacagcgtcatcacggtcgccaacctcgccattcagggggtgggcttgacgatttcggccgccagcatcctcaaacggattaaggaaacgccgatcaacctctacccactcgacccctcgctgatccaaatccgctactttattggcgccaaaaaggaccgtccgctcaccgacgccatgcgagacctcattgccgcttttcagtccgccaacctccaaatgaaaatccattgatgaaggcgcttttaggcaaaattagggttttcgtcacttatgttggcaatccggtggtgctataatttctgtatctagtcgacaggagggaatttcatgttatataacgcagccttagttttagaaggtggggcgatgcgcggtcaatactccaccggtgttaccgatacctttttaaaacaccacgttgaattcaaatcggtaattggggtctccgccggggccctgtgcggggcgaacttcgtttctaagcagtacggacgaatggctgacgttaacacccactaccgtcacgaccgcaattacatctcccccctgcgccttttaaagcgcgaggaaattttgaacttagactttttgtttgaagaccacggctgggactggcacaacttcgacgaacgggcctaccagcgttcggcgtccgatttcaccatcgtcgccaccgctctagaaaccgggaaggccgtcaccttcacaaacgcgacgggcgaagagttcatcaccgacctgaaggcctcttcttcgatgcccttcgtttccgagccccaggtaaccaccgccggtccctgtttagatgggggcgttgccgattcaatccccttcgacatcgcccaagagcaggactttgacaagatcgtggtggtccggacccggccgcgtgactaccgcaagaagccgaccagccgggtgcttagtgagatgtaccagcactcctttaaggactacccggccttcgtggatgccgggattaaccggccaaccgtctacaaccagcaggtcgaaacgctcgatcaacttgaaaaagaccggcaagccttcgtgatcgccccgacagaaccaattaaggtcaagcgtctagagggcaacgttaaaaaaattcgccagctctacgaacagggccaggcccaagccgaggaaatcttagccgacgttctcaactacctggagaactaattgatggcggcggagtgatcaaagtggtcactccccgcttttttcgttaaaatagatgagactgttaatattaaacaaatgagggttgataagtatggaaaaagttgttttcgttggagctgcacggacgccgattggaaagctcggtggcgccctggccacactgaccgctgcccagttgggaacaattgccatccaggccgccttagagcgggccgcggttgctcccgaagaagtgaatgaggtctacctgggctgcgccatccaggccggccaggggcaaaacgtcgcccgccaggccagcattgccgccgggttgccggttaccgttccggccaccaccgttaacgtgatgtgtggctccggaatgcacgccgttaacctagcggccaagctgattgccatgggggacgccgaagtgatggtggcggggggcaccgaaagcatgtcgacggccccgtatttgatgcccaagggccgctttggttacaagtacggtaacgccgaactggtcgacgccctgtataaggacgggttggaagacgccttcttccactacccaatgggttgcacggccgaaaacctggtcgaaaaataccaggtgactagagaagacctcgaccacttcgccctgcaaagccaagtgcgggcacggacggcgcaagacgcggggcgttttaaagacgaaatcgtgccggtgaccgtcaagggcaagcgccaccaacttgaagttacagaagacgaggcgattcgcgacacgacgatggaaaaattagcggccttaaagccggtctttaaagaaggtggcgacgtgacggccggcaattcttccggattaaatgacggcgccgctgctttaatcctaatgagcgaacgccgggctctggcggaaggcaaggaaattctcggctactggcaggccggcaccttggccggggtcaagccggaactgatggggatcggccccttggcggccaccaagaagctgctcgcccaggttgacatgacgcccgaccagcttgacctgatcgaaattaacgaagcctttgccgcccaagcgatcgtttgccagcgcgaattgggcttcgaggagagcaaggtgaacgtcaacggtggggcaattgcccttggtcatcccctgggcgactccggggcccgcattttggtgaccctactctaccaaatgaagcgccaaaacgccaagcgggggctggggaccctgtgcattggcggcgggatgggcgctgccaccctcgtctaccgttaggaggattgtatgcgtaaattattcaaactcccttatgcccccttagtggtggctattttcgccttatacctggcgattacctattggccaaacgttgcgggcctgttgaaaacattattggcggcagccatgcccctcttgattggttgcgtgattgcctacatcgttaacctgttgatggtacgctacgaaggtttataccaccgggtctttaagggacagcgggcccaaaggtttgcccgggtcaccgccctttgcctcgcctacttatcaatcgtggtggtgattggggtggtttctagcgtggtggccccccagttagtagcttgtgttaagttgctcttctccgggcaaagcaaggtcatcccccagttcatcaactggctagaaaacgagagctttttaaagagcctctggcaacaaattgacctctccaagattaattggactaaggtgcaaagttacctcttaaacggggccagtggcacctttagcacggtcatgtccaccgctagcaaggtggtctccgccctgactacgaccgtcgtagcgattttcttttcgatctacctcttgctctttaaagaccgtctcgcccgccagttcaagctcttattgaccacctacttgccggggcaagtggcccggattttacgggtactgacggtgtttgaccagtccttttctagctatatcgtggggcaagttaaagacgccgtggtgctcgggtgttcgtgcaccgtcttgatgctaattctccaactcccttacgcaccaatggtcggcgcggtgatggccgtcaccgccctcgtaccgatcatcggggctttgatgggggccagcgtggggatcatcgtgatcttcgcagtttccccggtcaaggccctgatcttcttggtgatgattctagccctccaggaattcgataaccgggttacttacccgttgatcgtcggcaagtcgattggcctgcccagcgtgtgggtcttcgtggccgtcatggtcggtggcggggtttccgggatcctagggatgatgttcaccgtgcccctctttgcggccttctaccaactattaaaaaccgacgttgccaagcggcaattaaactaaactcacccccaccctagtgcgccaaggtgggggtgatagtgtataataagcgtgtttttagttaaaggaggcggcagatttgacgttaaatttgttggtagtggtgtgtggttttctgattggctttttcgttatctcaaccgggggtggcggggccgctttgtaccttggggttttaacggggctgtgcgggttaagtgccgcccacgcggtggatacctcgcttctaaccgccatccccgccctgtgctttggtgccctgtccttttaccgtcacggcaacgtcaacgtcaaactagcccgccagtttctgtacttcgccttaccaaccgtgatcgtagcttccttgttggcccgctacattcccgaaaagatttacgccccgctgattggactcgtcttggtggtgttaggggttcaaatgtactttcgcaaggtgcgccaaacggaagatatccacgtcgaccgggtcaaggcagcctattacgccatcttgtccggtttaatgatcggcatcggtgggctttccggtggcggcgtgatcgtggccggcctgctagcgataggcgaagatatgttgggcaccgtggccacgtctagcttcatcctcgtttggacgagtttaatcggtgccgtgatgcacataactggcgggggcgttagctacttttacgccctgttactgataatcggctccgtaaccggggcgcttatagccccacgggtcttatcccgggttaaccgggcaacctttgaccggatttgcaagccagttatttccttaattgtgatcctgatggggttacagatgattttctaactcaactgaagaggccggggaaaattccgttttccccggcctcttgctgtattcacgaatgttagacagatagcgtggaaaataaccgcaggtctagtgtctaagcaggccgaagaacagtgcgtaccgcactaaccgttcgtcctagcttagtcatatgacctgccgagaaggttattccccaatcactttcctatgcgtacttgtgggctaacttaccgcacagggcggcgacaatcgcccctaacaaatcatcgatgaaggtgttgacctggtcgttatcctcatcgtattgcttgatgatcccgtacttgacccggtcgagataaccgaagttggttaccccaatcgtgccgtagatgttggcggtttgcagggccagggcttcatcaaccccgaagacgccggagtcgtttctaatgatggtcaataagggctctttaatttgcccctcttcggccaggcggtcgagttccaacgccaccatcgcgttgttcaagagttcgcgtttgtgcaacacgttcagcagttcttggtagcactcctcctgggtaatggtgggcacgaagttgtgctgtaaatcataggcgatcccactcaactggtggaggtccaccccgcgctttttcagtccgtcaataacgaagtcaaaggcagcggtgtcgggatacttaaagtctttatttaacatgctacatcctccttaatcgagttcctaagccagtttgctgtagtaatagcggttcagttgcgtccgaatcgtttttgcggtccctaggttgatgttattagtgaaaaagatcatccgctgctgggtcgaaaagtcccccgaggcaatcgccgagtaaccagcgtagcctccgttggtgtgaaaactattaccgctaaagtaaatcccgccaaagtagctaaccgtcttttggtcggcgtacttatggagccaggtgctggctgcctggtcgtccatcaagtggctaatcaattgccaataacctaccggggtcgccaagtagttcccggccccaaaggtcgccgacatcgcccgccgcaagctcgtccaagaggccgttggcaaaaggctcttagacacctggctggccttcagcgcactaaagggtttaatctccttaatcccccacggcgccaggattttgtcccgaacgaactgatcatagctttcgccgctgaccttggaaacgatcgcggctaagaggacgtaatcgatgttggagtagttccaagtttctttaccactcgacttatagtgggccaaggagtatttgacctgttcgctttgactcatgaggacccgtggagcgaccgtctgggtgtcggcaagccccgaggtgtggctcatcagccacccaatcgtaatttccttcgcgtgggccacttgggggtagtaagtcgccagggtggtgttaaccgataatttgccctccttgacgagggtgtagatggctaatcccgtcaacagtttttgcagcgacgcagtcgggaagtaacggtggctagagaccgcccgttgactgttggcccccaccagtgagttttgaatcacggtgggtgtgtcatcgctaccaattaaaagaatcccgttgacgtggttggatttaagcacgtccttgagcgttaattgaagtcgcttggtggttgaaattacttccggggcgtgtacaatccgggggcgaaccccagtgatcccgattcccgcaagtaagccaagagccgtgccgaatagccatcttctcttcaaagatcgtcacccttccaatttttcgcggcgtcttctttattcagttgcgccagctggtcgatcatcgtcaggcgttcgcgaggcgagaggttacgtaagaattcgaaaaaggagtccggaaacttcttcattaggtcaatgaattcctgggtggtcttatccggttgggcaatcatgtccttgtagcccaggtttagatcgatgttggattccccccaccggttggcgatcaccacttggaccgcccgcatgaggacgtggctatccttaatcgaaagtatttcggtggtctgcatgtacataatcaagtagcgtaacgctaataaaattggctccggatcggcgtcgtctggggcgaaggcctcccactggaggaggaagtcggtgggcgatgttaggtcatcaatgacacacatcggccaccgctgggttaagtagtcgtttaggtattgatcgagcaattccttgatctgaacccgggtcttttcatccgttgtggtgtaggtttccacccaggtcatcaggtcagcgattagttcggtgttaatgtcgatcaattggtcgtacaccgcttggacttccggggcctgctcgtcaaagttagctaagtaggttggggagttgtttaagtccacccaacgccgtacaaagtaattccccttgttcgtgatcatcgggatccggacctggttgacgatttgatcggtaaagttgatcatcggcgtttcctggcggccaaaccgttcccggtccgcgagggtgaccgattccatcgctaaccccattaacaggtcgttttcctcgtagctttctagttcttccggggtgatcttgctaaaggcgtccacgtagtaacggaaggcccgctctaacaagaagtcattgctcgtgttccggtaggccaccccgccgtttaagatttgatcggtgtagcgggtcgccttatccgggttaatggccaagcggctgcagatttgcttaaccacttgggctaagacaaactcaaccccgacccgcaggtattccactcccggaatgatggcgggcatcagggtttcgtgattaacggcgaggaccattgagatcccgttaatcgtaaacgggcggattgtccagtcgcgtaaactagtgggactaggtttcttttcctcacttaatttaatatcttcttccagaacgttggatgcgtacagcatgttgttctctcttccttattgatttttggttgggccatcttcttttcttagcccggctttgaccaagtccttagcggttttactgaccgactgaccccgttgctcagcgagggcttttaactgacggtaaagggccatttcctcttcgcccttccacaacagcccagtcacctgatgaaattccttttgcaaaagacacctactccttcccccaaatcacgtgggcaatcttcttgataatcttgacccgttggtgaagctccgtgtgggtcgtatcggtgaagatgtgttggtgatagtggacgtgtttgtgtttaatcagggtttttaacattagtgattggatttggggaacttcgccgtcagtggtcgatttcccctcgtcgcttcccatccagttataaaagactagtccccttggtagctgtgcttccttaacctccttgagcatcgttttaaacatttgatcgtgagactttttgaataaccacttggtgtacttggtgttggtcccaaacgattcgtcaaccgggacccctaaaaaaaccaccttttgcaaggcgatttctcgttgcagggttttggacccgatgtaggcatgcaaaagctcggttcccccgtaggaatgggcgatcacgtttagtttttgaacgtgatacttagtggctaacacctgcaaaacctgggttagctcccgcacctggggctggtaagtggtggaataattccagtcgtaaatgaactggatcagtgggttttgcttgcccttcaagctacccgaaacctggacggctccggtgggtgctacccggaccaccattacgttcgtggcgatgttttggtcctggtagtagtcaattaatttcgtataggtccacgtgtttccaccccagcctgggatcaggagggtgggcgtggcggaatactttaccgatgagttggtgggggtgatggccttacccggggttccccgcagcaagtacaactgaacccccgccagtacgacgatgatgaccgctaagccaatggccacgcggcgcaaaaccttcttgaacatggtcaccgcctctttgcttccttgaccatcataccctttccggttccgcttggctagttagattatgtgtgcacaaacaacaagaggccctcagcacggttcgctacgtgcgactggagaccattgaattgagttatgctagccaaacaaccgggcccaaaagcccttcttctttggttttgaaacctgcccgtgttcaatcgccgacggcacccgtggcgtctctgcgacgtcataggtttcgtggacggtcaccccggctggcaacgccatgtgagggttgttgatccccaaccagtggtaaaaggcgccggccttaatttcgacaaacttcccggttttaccgttaatcccgtcgacgcaaatttcgattggcaaggagttgcggtactcttcgacggcgtcttgggtaaagccgttaaaggagttgagcttggagatatcaaagagcaggctgtcgttttccttgcggtagacaaagtcgctctcttgggttaagtacagcttagcccaacgattgcgtgagctctcgcggaagtcatcgaaaatcccgtcggtgaagtagtccggcagcggttggtcgaccatttggtagtactccttgaagatccgccgcggcatggccaagaagtcgagcaggccggtttccttattgtaggtccgccacggggtttggtcgtcttctaagaggttggccatccggacgacaaagtccttgaagagggtgttgtttaagatcttgcggacgttgtaaatgtacttggtggcctccgatttttgctggtcgtcaatcaccttatccagttgcaggtagtaggtccgccgggcggtttctctggccatcgaaaagcccccgttgtagttagtggtcccgatcaatggtgcgatcggcttggggctgttaaccaactggttcatcgtgtcgacgaccaagtggcggctgtactgcggttgctggaagaagtagggttcaatttcatcaattaggactgggtaactggagcccgtcttcatgtacaattctagggcctggaccgtcttggccttgcgctgcggggtatcggtgtcgtaaatggtgccgaagtcaatcatcgagttggcggtgttccaggtcagctggttaatgatccgtaagagagtcgacttccctgacccggccgtcgcccctaggatcaagaagttaggcacgtcattaccgtcctcggggttcaaactagccttggtgcggatttcccataaaaacggcgccgcaaagccgtagaggattgcctcaaagaaccggcgcccgtattccggggtgtaatcgaccacgaacttggcatagccctggatcacggcgtcaatttggtgcaacccctcccgaatttcagaaacggttgctagcttcccaaacggcaaggggtaggtgccggtgtcgttgggggtgtagaggccagtagtgttacgggcaatgttgcgttccaggggccggtcgtacaagaaggtggtgtactttttttcgaccgctaagtcctcgggggtcaccgcctgttcgaaggcttccaccacccgtttgttgatctgagcccgttcccgtagcttcgggtgggctgcccgcggtgaaacggcctctttttccaacttcaggatcatttcacgctgttcaatcgcccgctcggcctcgtccttttcggtggcgtaattgaccgttacgttacgcaagcccagcggcagttccgggtcgaccagttccttgtcaagctgacgttgcacgtcgttgactaagaggttggtcaactccacctgggcgatccggtcggtctcttcgttagagaggatcaccacctggctagcgtcggcatccttgtccttttttagggccttgagttgcttttcggcggcgttgagtagttcattagtgaagtagggctgcatcaccggtagcatgtcaaccttaaagtggttattcaagctttcgtaaagcgggtggttgtcaaagatgagggcctcttcaaagcggttgtgggccgggtcaaaggaatcttcggtcaagttaaccgaccccaacactacccgggtttgctcggtagtcgggttactgagcaggtaaaagcgggagtggaccgcttgggttggcgaaatgtccagctttaacagcccggacacggcgtttaactgcatttggctggttaaagcatgaaaaagcttagccgcttccttgttggcggcgtttaacatcgccgttgccagggcgtctttagtgatcgtttcggtggcggtgtacccggtcgccgtctggcgggcgcccagtccgatttcgacctttacaaaatcgggcaagtaggtgttgataaagtcaggcgtcaccgctccggtcatggcgatcagctgggaatacttttccggatcaaaaatctctttaatccccagttcagccggttgcccatcgtggagaacgtggatcttgtgcaggtcccgtggttggggggtcgtcttggtgcttgtcatcgaataaaccttctttgttgtaaattatgattcgttaagaggggcgccgtaattctcataattactccttgccaccccctcccctcgttgctaaacgattgataaatcattgatgatttggtgtcgcttccaagggcggaccgacaaacatcgtggtttgccttagtcacatgataattttatcttaccacaagactcccccgctcgcccggtgggatcgtgatttcatcattttttcgtctcaagcagggcgccggaccgttaaccacgttagcttgaaaacgatttcgtgatatactaattacaaaactaatcgtttgctttaagaaaggagaccactatgaccatcaaaaatgtaaccatcgccggggccggcaccttagggagccaaattgcctaccaatccgccctcaagggaatgcgggtcaccgtttggaaccgccacgttgagagcgccaaaactcgtttgcacgccttaaaggatgcttaccaccgtgacctcaagctttccgaggccgattttaatgccggcctggccaacattgtcgcggtcacgaccgacctaagagaagccgttgaagacgccgatttagtcatcgaagcggtgccggaagccatggaagtcaaggaagccttctacgaggaactcaaggccgtagtccctgataagacgatcgtggccagcaactcttcgaccttcatgcctagtcaattggtgaagttctttggtgacccgcgccgcttcttgcacatccactttgctaacgaaatttggaagtacaacgtcgccgaaatcgtcggtaacccggacaccaagctggaactggtggaggaggtaattgactttgctaaggccatcggaatggtgccgatccacctttacaaagagcaacccggctacgtgctcaactcacttctgattccgtttctcgatgccgcaatggcgttgtgggtcaacggcatcgctagcccccacgaaattgataaggactggatgatttccaccggctccccgtctggcccgttcattatcttggacacggtgggcttacggaccgcttaccaaatctctttaaacaagcaccaagccaccggtgatgaaatggccaagcaagtcgccgacaagctcaaggaaatgatcgatgctggccactacggcagggaggccggccagggcttttaccactacccggacgccgagtttctcgccccgggctttttgaagtaggcaacgtaaactaagcaaaaatagctgaggatcacgttaactaagcaaaaagaccactttctcccttgacggttgaaagtggtctttaatttagttagtagcggtggccttcccagtggcgtaattgatcgtaatgttattttgaacgttcggaacaaagacgttgaactggaggctcccgtcctttgacttggcctcaatgtgggcgccggacggaactaggttgttaccgtcataaatgtctgttacccggtagcggacttgcttaccccggtcgagggccttgcgaactaggccttcgtagtagttttgcccgtttgaatcggttgaccgggcttcgttagcccaagcggtttgggtggcgatgtttttcgggttggactccgaagcgttgaaaccggagagccccccgaccaaggcgtagccgagtaggtgcccccggtcataagcgtgggtcgggccgttctttaagttggtcagttgcataaagccgaccggtttccaactagtggcgccgttcccggtttcggaacgattcttgtattggcgcgtcgttttgtttaaccaggcatcgccctgccaagcacgcccctggctgtcgagccggtcaacggcgtagggcgcgttgttgatcttggcgttgagcttggtcttattgttgttgataatgaaggccccatcgccattccaagtgatcgaactccccagttgttgcttaacgttggcggttaaaaccgcctcggccttttgcttgctcggggtgaccatcgtgctcgagccgctggttgacgacgagcgcgaccggtagcttaggttttccaccagggagttgaccttggcaaccagggtttgggcactcggtgaactagtggtggtcgtagaagatgccttgcccgggatacccgaggcaagggcgaagaggatgacgaaggcaattaaccagcgccagccctgcttcttgttacgtcggcgtttcatgattttcctcctcgtaggtgttgggttgtctcacccccattatacccgttggaacgcctgttcgctacttaattctaaaactgcaggtgctcgtttaaaaaggcctcctttacgcagtcaccaaggagcttagtcccctcctcgaccgctgctttagccatttgttcattgacttgggtcaaaaaggcgtgcaggtctgcttctcccgccgccttcgcatcggcggccacttgtaattgacggcccagcgccgttaccgtttgctcgtaggcctcaaccttaggggccaaagcccggtagtggtggtcgccaatcgccgccagggtgtgggctagccagtatgccttggtcgggtcgtactgaccgctcgtgtcccggtaggcactcggggtgtcggtaacgttggcatagaagggaaccagagcgttaaaggtgttgggaccaaaggccagccaatggaccgccgccacttccggcgccactcccgcccggatttctaagacgtgtagttctaggttacggttcaaggcgattgaacggacctggccccccttctcaccaccataggggtcatacggggtaccttggtaatgtgatgacatggcctgtttgatgtcttcaaccgccaaccggtgcttggggtggcagataaaggggaggtccatttgggttgggtccgcccctgtttccaccccgaatagcttctgaacgtaccacgcccgcgggttgttatagcgcatgtcccggtaagtgcgggaaccacaaatttgccgtaggttgtagccatcatcggctgggtttaagtcgtgttggtcaatccagtccttgaggtcggggctagccaaggtggtcgcactctcaaagtcaaagtcggtgatgttaaaccggttcggcgcgattacaaaggcgtcgtcggggatccggaccgctgcccagcggtgaccgccaatcgtttctaaaaaccagacctcgtcttggtcggcaaaggcaatcccgttggcttcgtaggtcccgtattgttctaacaactgacccagtcgctctaccccttcgcgtgccgattgaacgtacgggaggaccagggtcacgaagtcctcttcaccaatcccgctttcctggttaaaggggtcgagccctaagatacgcgagttggtggtcgatgattcggtcgccgtcattgccacgttggcctgattgattccccccgccgcaaagacaccggcgctactatcgacgtcaggagtggacgtgtagcgtaacgggttttccggtaaatcacagatgaagttggtggtcttagaagcgtagtggcggggttggtcctggggtaaaattacccgaaaggactgggggttaaaggcgttaccgtaatcttcttgacgggcgattaacggggcgtgatcgagactggcgtctttaccaaccaaaattgtggtgcagggcattagaattcctcctttttggtgcggcgtagcatttcttgcatcatatcaaagagttgaccgatctttcggtccgctaagatgcgggcgtcttcgcgacgggaattcttcaagtattgaccggctcgctttgaatcgccaaggatttgccggtaattaggaataatctgggcggtgttgatctccatttcgcgatcaaagtcgtgctcctcaagtgagttaatgaagctagcgaagcggtcgttggccacctgctcttcttgcagggcttcatcgaaatcgtagtagttgagcatcgccaaaaaacagaggcggaaataactacgggtttcctcgtccattggcggcagcgttaaaaagaggctggtgtagctagcgccggctaagaaccgctcaatgtaatcggcgtaatcacggcgttcccggttggttaaatacccactctcttcttcgccccagtaatcgtcaaaggcaatcacggcggccactaaaaagtcgtcgacggccattcgccactccggccggctatccccgctctctaaaaaggcaaaggcccggttgccaaaggactcggcgtttggccagagggcgatggcgtccgtaaagtacttgatcgctaagtggagatgtccatcaacgacggcctcctccccctgtcggttgtagcgcatggcaagtgtttgattgtagctagccatttcaaggcccccttcattggaattattatggttcattttactctctttaccaaggaagcaccaaatttcggtttaaagctaattccatggggcgaattgtcaaactaagtgcaacggtttgtcaaaaaatacttcatatggggtttcatagtttaacactttgcgaggacgttgatttaactgcttttggcagtgttcaacgtcctgttctgtataattatcaatatctgttcgcttgggaaaatattcccggattaatccatttgtattctcatttgttccacgctgttcaggcgaatatggatcgggccaatagacagtaatacctaacctttcgctgatttcatcaagatgaagaaattcggtcccatgatctggtgtaatagaatgaacaaattctttaggaatggcccctaacagttcaactaagcctttatttatctcctgcgagtccttttgcataacctttttgataagcgtaagccgactaagccgatcgacaaccgttaaaaggatggagtgacccgttcgaccaatcacagtatcaatttcccagtcacctatacgttgacgctggttgataaaaccagggcgctcatggatcgagatatagtcggtctgtacttctcgatgtcgtctagtattctttgaatgccgggtccgatgtttatgtctgagatggcgctgaataccggtatcaccacgtgaggagtacttttcacctaaattgtgttgatagatatgacggtaaattgtgttgtagctaacacaccattgatgttccttattaaagcgagcggtaatctgctctggtgaccagtgcagatctaagatgtaatgaacaatttgacggcgtaattgtggatggctgtctaatagccgcttcttgtgacaattctgccgcttttgatgatagtcattatctgctttgcttggggaataattacctgcacaacgttttaactcccgtgaaatagtgcttggatttcgccccagccgtaacgcgacagcccggatagataaccccttagctcgtaaaaacataagtatttcacgttcttttatagtaagatgtttatagctcataccggatacctcgaattgtttaatttggtcgttaaacatattctacccggtatgggtttatttttttactttgtgttgcatttcaattgtaaattcgccccacaaaaaatagctgagaccgcgttattcaaacgttggtcttcagctatttctttgctagcgaaaggaggctgttccgcacttccactagttaatgttatcctgaatcaactgcttacccaattccgggttgtcggagtagtcaaccgggatatcgaccacaaccggcccttgggtggcaaaggccttgtcgagaaccttgcccaggtcagcggccttttcgacccgcagtcccgtggcgccgaagctctcggcgtacttggcaaagtccaccgggccgaacttgaccccggcgtcgtggccatacttgagttcttcttggaacttaaccatgtcgtagttcccgtcattccaaaccaggtgcacgatgtttaagttcaagcggaccgccgtttccagttcttgtgcggagaagaggaagcccccgtccccagatacggaaacgaccttggaatttggccgaaccagggcggccgcaatcccccatggtaagcccacccctagagtttgcatcccgttggtgaagagcaggtggcgtggttggtagctacggaagtgacgggctaaccagatgtagaaggaaccaatatcggcggtcacggtcatgtcatcgtcaatccgttcttgcatcgccgcgacgatgttgagcgggtggttgaggacttggccttccttaactggcttgggttcgtcgcgggtcgtgacctcaatttgaacctggtccaagaaggcccgggagttcttcggcacgctgtaaccagtcaactgtggtgacaagagggtcaaggttgaagcgatgtcgccgatcagttcacgttctggttggaagttgttgtctagttgggcttgcttggtatcgatcacgacgaccctagcgcttgcggtcggatcccagttgcgtggttcgtattcgatcgggtcgtagcccacggcgatcacgaggtcgctttcctttaagacccggtcccccggttggttacggaacaggccgacccggccgaagaagtcgctttccagttcgcgggaaatgatcccggccccttggaaggtttccacgaccggcaggtgagtttcggccaccagctggcggatagcagcggtggtttcttcatcagaagcccgcattccgactaagagtaccggtaacttggcgtctttaacctgtttggctaaccattccacgtcactcaagttggctggccccaacttgacgtcttcgcgcggagctaacggggcggaagtgacttccccgtcggtgacgtcttgcggtaccgaaacaaaggccgccccctgctttggtgcgacagcttcttggtaggcgttggccaagacttcggaaaggttattcgggtcttggacttcggcgctgtacttggtgaccggcgccaagagggcggcgttgtccatgctttggtgggttaggcgctttaagtcccggcgcggaacttgcccggaaatggccaagaccgggtccccttcggccgtggcggttaccagcccggtggccaagttggataccccagggccagaagtggtcaagaccacccccggcttgccggtcaagcgaccaatcccaccggcaataaacgaagcgttttgttcgtggcgggtcacgatcaacttcggcgccttcgggttcaccgggtggtccaaccgttcaaagagccggtcgatcttagcccccggcaccccaaagacgtacttaacgtcgtgattagcaaggctgtcgacaatcgcgtcggccccgtagcgtttcttttcttctctcatttcaattctccctttgcctgaatttcgaatttgctcactttggcgtctctcttatcagatcctagcaccaataattcggcaataccagctaaagtcgcgctaatcatcgtgatttattgaacattcttcccctctgtttgactttgttcatttaaacacttgtctttcttcttaacaaagtgcaaatccctttgaaattaaacctaaattctagtagtcaggggcgactgggcgcacccaaaagtcaagaaatgctttgtgttgtgatcaaacgaacacaccaaaatttttacaaacttttgaggtccggtattacatcaccattccactttacgttccgttcggacgttattatgcggtgaaggaaagtagggattaaaagaatagaggctgaggagcagattccccagcctctatttctttaacttttgcaaagataacgtgctccccaaccacaggcctagtggccaagtacgggcaatgaacggtgcgttccgcatcaacccttgccctagcttagccatacggcctgtcgaggaggttggttacacttcccttaatttatctccaccttcaaccggtagccccggctagcgtagtaacagtcggcggtgttgtgatagatgaaggcgcggccaaaacgcttatcgccaaagaccgccccgccgagcttgcggacgccagcgggcgtggccagcaagcaggaacacttgaggtcgaagtcgccgacgctttgcaagagaaggtagtcctcctcatccaagagatgggcgccgagttttttggcggccgtcaccacgcccccggttggcgggttcttcttgcgtttgaggcgggcctcttcgtcgtaacaaaggctcttgcggtgcggaatcttggacgcttctggagcagtgtcaaaaactgtggccaacttctttcttcaacgttcatcgcctccctttatttacttaattatacctaaaatattacttaaaaagtatttgattatatgaatttagaatattaattaatgcgatttataaataaaaagatgaagccgggaaaatatccgtttccccggcctcttgctgtatatccgaatattagacagataacgtgctctcaaccacgggcctagtgactaagtacggacggagaacagtgcgtctcgcactaacccccgccctagcttagcccaacggcccgtcgaggaggttgaatcgcactcactttgataacgtgctctcaaccgcagacctagtggttaagtacgacctgctgagaaagttattttccactctcaagctacgtatcaaattcttctcttctgacccctacttaggggtgcaaactaggagagcgtcttcggtgaccccgaacggttcaatcttgcgcccgtctgccgaccaaatcgggtgacggaagttgtgggtcgctaggtcgaccagggttacgtgacaactatccttggttaaaccgagggcgcctaaatccacctgcttggccaaggccgaataaatgatggtcttgtcccccgccttagcgacgagtaccccggcgcctaggtcatcttgttggggcactaattcggctaggtttaagcactcggcaagatgctttaagaagctgaagtcgtcggccccaggtgcttgaagggcctcgtgccaatcgtaagggtgttcgtacaagaagggtgcgccaaccgtgtgccaactccagatcccgtgggcgccgtaagtgaccccggcgttggccccggcaagaagcgactgccaagctgccttgcggacgtccgcccggttaaagcgttccttaatggtggcgtcaaacttaggcatcagctcgtagcagggttccaagttgataatcggctcggtgtaaccgcgggagcgcatggtttgcgggatcgtaaaggaggtgtcttgtccgggctttccgtgcccggattggtaggcaaaaaagtctgccccttctagcaagctctgcggtaagttggtgctttcgccgttgatgtggaaggtagcgagagcctggggatcggtctggcgtagaacccgtaggacctcggtgtgtaacgggtgatctcgcctagcgtctttgggtcatcgtcggggaagttgacgtcgccgctcaccaggtagagtgggtggtacttttggaaccgccgggtgaccgcttcgacgtaggggtgaagctggtcaaacggcatcgggttgttgtggatcagctccttcatccaggtccccggtacgtagttggcccacaacaagaccagggccggaaccatcccgtagtcaaccaccatctggatcatcttctccgcccgagcaaagtagtcctcgttaagttgctggtaatcgtaaacgtagccctgttcggtataagtaacggcaaagggctcccgttttgcggccaccgggctggcatcccactggcgcaacaggttaatctgaatgacgttaaagccctggctttcccgcttagtcaggtagtactcccagtcactgagttcggcgttcgtcaaggcactccacgccgtatcggccaagtagaagaaggggcgcccgtctttttctaagtgttgttgtttaaccgttaacatgaccatcatcctttgcttttctactagcgtaccctggtgttgacggtagcgacaagcgggaaatgaaagcggtttagtgttcaattcccaggtttaataaaaacggctccccacttggccaagtaagtagggagctattttctaatcgtcaaagtcttctaggttatacgaggagccggtcccgttcttgatgacgtcttcacccagttccaccccttcgtgaaggctgtagatcgactcacggcccggcaagtggggttccatcttcgggtcggagaagatcgaaactaggccgggggtgaggtgggcggccttaacttgggccggggagatctcgtggatgatctcatccccccgcccctctgcaatctttaagctgatctgcggatccatcagggtagcccgtgccagcgccaccaggtcggtttgcttaagggcgtcttgcatgtcctcttcagtcattaggttgccgacgatcatttccttggcctgatcaccaatcgccggggcaaacagctcggcaaaggtcttatccgaatcggctggcttaccgttgtactgcggcatcgataggtggatgtaatcaaggtcgaattgatcggtgattgccctgattaactgcgttgattcgtgccaggtgtagccgaccgtgtcgtggatttcctccgggctgatccggtaaccaacgatgaagtcagccggggcggcttttttaaccacccgtaagacctctttgaccacttctaaggggaagttcatccgcttctccaggctaccaccccagtaatcggtccgcttgttggagtaagcggagaagaattcctgaatcaggtagtggttagcaccgtggatttccaccccgtcaaagccgcactcaattgcccgcttggtggcccggccaaagtccttgacaatcccccagacctcttcttcggtcagttcgtgaagcgggtagttgacccaagcaaagtccattgccgatggcacttcggccgtccgccccatctgcggtgcgtaattggcttcccgccccgagtggaccaactggagaatcgccttgtgaccgtcttttttaagggcggtcgccagtttagtcatcccgggcttaaagctgtcgtcaaaaatcgctaactgggtccgatcatcggcccacgagcgcgacggcccaccattcttgctgacggaggtgtactcaacgatcaccatcgccgccgattgactacgggccccgtagtaatcaagggtgtcttgggtaacgtattcccggtcccccgagttggtcagcatcggtgactgcacaattcggttttgcaaaacggcgccatggcgcaactgtacttgatctgtcaaagctttcactgtctttcacctaacctttctgttgatatgttaaccatatcacaaaagtgggcgtaattaaatttaaccttcttgaaccctttgttcagtcctgcttaactacctggcacccatccgtatcagttccatggccgcgtcctggtcaatcaccagggcgttggcgtagccgccggttaaggcggcggccacggccggcaccttggctaagcccgtcgccactaaaaccgagtgcttcttttgccgcagctggtcgagttggatgccaatcgtgcggtcgttaatggttggcgagacgatctggccgtcccggtcaatgaagcgggagaagacgtcgccgaccgcgtgttgttgcaagaagttctgctcctccttggtaaagtaaccgagcttaaagagcagggccgaatcccggaccgtcccgaccgtaaagaccgcgattggggcccggttgcccagttcgatgacgcgggcgatttggcggtcgctttccaccagctgcttggtggttgcctggtcaaaaatcaccggcaggggcaggtactcggggaaggtgtggaaggcggtggcgaaggcctggatgctttcgtaggcgtaggtgggctgctcttggttattggcggcccccttcatctgaacgacccggacgtcgatcaagggttccgggcgcagggccagggccacctggtgaatggttttcccccacccgatcccgatcgtatcaccgttttcaacgatcgtctccaggtaactggccgccgcttggccgaccagggcgcccttctcttcgccggttgcctgcccggtcgccacgatcttgacggccgccaggtggtagcggtccctgagttcctcggccagcgtcacttcgtcttctagggggtccttgatgtggatctcgaccaacccctgttcgcgggcgtaccgaagcaaacgcgagaccgtcgcccgcgagacccccagttcccccgcaatccacgactggttgtggtcgtctaagtaatataacttggccgcccggatggcgtcccggcgccgttcgtcttctaacacacgatcccctcccttttcaatttggatattataccaaaaaaagcgggaacgcccctagtcagtccccttaggtctgccgagaaggctgtttcccactcaaatctattgcttaatcgccgtttccagtgcgatcttgatcatgtcgttaaaggtccgttcccgttcttgggcggtcgtcttttcgctcccaaagatcaggtccgacaccgttaacaccgacagggccttaaagtgcaacttcgcccctagtaagtagaggccggccgattccatttcggtccccaagaccccgtagtcggccagcttttgcatgtccaactcgtcgttgtagaagcggtcggccgcaaagatatcgccgaccttaacggagacaccgaggtccttggcgacgtggtaagccgaatcgagcaactcaaagttagccagcggggcgtagtgaaccccgtagccaaaggtgttggcgaccaccgccgagtcggtggacgaccccgacgctaacaagacgtcgcgcaggtggacttccgaggccatcccgccgcaggagccgacccgaatgatcgtcttgacgccaaattcttttactaattcgttgatgtaaatcgacattgacgggatccccatccctgagccttgcaccgagatccggtggccatggtattcaccggtaaagcccagcgcgttgcggacggcgttgacttgtttgacgttatccaaaaaggtttcggcgatgtacttagcccgcagcgggtcgcccggcaagaggacggtttcagcgtaatcgcccatttgagcgttgatgtgcgttgacatagtggtcatcctttctagttgatggtttcgtggattaaggtcggggcgccggcggtttcaccaagctcgatggcgtcatcaagcaaggcggttgccgcgtccaagccggtttggtcgtggtggatgattaacaatgcttcacccttttttaccgggtcgccgagcttctttaagagttcgatcccgaccccgtagtttaaggcgtcatcggctttttgccggccaccgcgcagcaccatcgcggcctggccaatttcgtcggccaagagcttggtcacgacgccgctctgcttggcgtggggcattagggagtaatcctcgaccacccggccgtcgccaccctgggcttcaatcatctcctgaaacttagccagggcccggccactggtcagggccgcttccaagcgttttcgggccgttactaagtccggcgcctggtggcccagcaccagcatctgggcgcccaaggtgttaactaattccattaaatcggctggcccctggccctttaaggcgtcgagggtctcttcgatttccagggtgttgccgaccttgttgcccagcggctggttcatgtcggaaatcaccgccatgcactgaaggccggcctgttggccaatcgacaccagcgccttggccagcttacgggcgtctgcttctgtttgcatgaaggcccccgccccggtcttgacatcgatcaccaaggcgtcggtgcccgaggcgatctttttggacatgatcgaactggcaatcaagggaattgagccgacggtggcggtcacgtcacgtagggcgtaaatttccttatcggccggggcgacggtgccggtcgccccgacgatcgccaggccaattttttggacctggttgataaaggccgcctcggtcagatcagccttgaacccggggatggcgcttaagtccagctggtcgccggattccatcatttccttggtcagggtggtctgctcttgcgtcgtcatcctctttaaatagatcgccatcaagagggccgccgtttggtagtcggggatcgtgtggttaacgacgacggtaatgaattcgtggatttctgtggttgaaagtgtgcacccatctcgtttgtgggcgatgatgtcgagcattgccattttttcacccctcgttcgttacctgtgctaaaaagctcgtcccggtcccgaccggagcgaccttaaagttagccagaaccgtcgcccccatgtcggcgtaagttggcagcacgccgaggtccaggttcggttggttcattgacggcgagtagaccagtagcgggacgctctcccgggtgtgatcggtccccttaaagcacgggtcgttgccgtggtcggcggtgatcatcaagaggtcgtcgtctcttaagttatccagcaccgtgcccagccgggcgtcaaagtccatcagggcctggccaaagccctcggggttgcggcggtggccgtacatggcgtcaaaatcgactaaattggtgaagcaaaagccggtgaagtcctcttgcatcacggcgtcgacgtggtccatcccgtccatgttggactcgttatggaagccccgcgtgatcccctgcccggagaagatgtcgttaattttgccgatgccgatcacgtcgaagccggcgtcctttagggcgtctaggtcggtgtcaccggtcggggccagggagatgtcgcgccggttagcggtccgggtgaagtggtccttgtccgggccaacgtaggggcgggcgatgatgcggccgaccgtgtattccgggccgttgaccagggtgcgggcgtactcgcagatccggtagagttccctaaccgggatcacctcttcgtgggcggcgatttgcaggaccgaatccccggaagtgtagacgatcaggtcaccggtttgcatttgctgttcgccgtaatcgtggatgacctcggtaccggaatagggccggttaacgatcacgtggcgaccggaaaactcctccagcttggtgatgattgaagcgggaaagcccttcggaaaggtcgacagcggccgggtaaccggtaagcccatcatttcccagtgaccgtccatgctatccttgccggccgagacttccgtcatccgtccaaaggccccaatcgccggcttggccaccggtaccccttcaatgggggcgccgtggaggttggataagccgagccgccctaagttgggcagggccaacttaccctggtaaaactcaccgatgtgccccagggtgtcggcaccctgatcaccaaactgagcggcgtcgggagcttggccggcgcccacagagtcgagcacgatcgcaaaaatccgcttgtaagccatttgatcgcccccttaatcaaactcgctaaggatttgaacggaagccgaaacgccgagccggttggccccggctgctatcatcgccagcgcttcgtccttgtggtggatcccaccggcggccttgatcttgaagtccgggccgaccgtttcgcgcattaactttacgtcttcaaccttggccccccacttggagaagccagttgaggtcttaacgaagtcggccccgccagcgaccgtcaaccggcaggcgcgccgcttttcgtcgtcagtcaagaggcaggcctcgatgatcaccttgagcagcttaccctgttcgtggcaggcgttagcgacggcctggatgtcttcttgcacgaagctgtcgttgtcatcctttagttcaccaatgttgatgaccatgtcgatttcatcggcgccgtcggccagtgcctgcttggtttcagccaccttgatcgccgtcgcgttggccccgagggggaacccaatcacggaacaggtgttgaccgagctgtctttcaagccttcgtgaacgtgcttgacccagtacgggttgacgcacaccgaggcggtgttgtattccagggctttggcgatcgtttggtcgataacttccttggtcgcctcgggcttgagcatcgtgtgatccatgtacttggctaattgtgctttcgttaattccattgttgcaattcccctttcgttttttacaggttcattgtaatcgctttcagaaattatgtccaacgttattttgaaacattttgcaaatcagcccattaaaaatgctcaccgttaccctcccacttgggatttggcacggtgagcattctcattaattttattttattaatcaaacccaaaatggaacttgggcgttttttctgataaccctatcaagctctatctaactctctaaacactagtgttaccgaatctccccaaagtaatattcgtcttcgcgtcccagaaactgagcccagcgcgccgagatcatcttggcgtagcggagcgggaaaaggccataattgcccagtgaataagcgtcgttggcctctaggaagatggtttccaggcgcccatctgccgaaaaccgaaaacggcgtgggcaatgttaattgggctaaaggtcgtgatgtccgttttaatcactttcgcccagactcgcatggttactcctccctttcgtaacctaaattacaatcaatcgcggtttcccgactgacttcaagatagcattgtcacctaaaatagtaatttgttggtcattaacagcattgggtaattgatagagagttatcaatccagtatcaggaatttcgctcttcaaaatttcaattagcctccgctttgtctgcttagagactacttctcgttcgtaaagactaaattgcttcatcatgaagcctagctcaaccaagcgctttcggtacttagcagcttgtttacgttcatccttggtattgcgtggaaggtcaaagctcaataacaagatcatatcagatccctccttcgataaacgaaggaagttttaggttccctgaactgttattttcaatgcaggtggttaaggtatcaacggtaaggtagatcgcatcactcaaatgcatcacttgcccattgatgacgcacttctcaagtaggatcctgacaagcaatcttcgttcctcagcatcgaactcgttatcttcactaagaagaatattctttgcaatgtagttatcaacgaaaggtcggtaagtttcaatcacatcatctgccagattatacgggtttgcggttgattcatggtgaatcccaaaacttggttcaaatcccttcatcaccaacagccgcctaatttctgcacggatgattgcatagccatagtttaaactggcattttgaatatccttcgttcgtccccgtttaaaggactgaccaaataagaccttgaagtagttttttgctgcgacggcttccccattatgctcatcaccatcaacaacggtatttgaaacagagcgaactaatgcgacgtcatctgtattagcctcgtttagttccaaacaacgagcttggttttcaatcttttgaattacaatctttcgccagatccgcttcttcaccttactagttaaggttagttgctttttcaagcgttcatagcggtgttcctgattgtaggtagtctcgatcatttctaaaggggagtggcttcggtcacaaaataaaattccaatgtgattaaggacacaatattcaatcacccgctccgatagataacactttctattattaaataccaacgtaccgatatcatcaaaggtcagatacttcttttccttcgtcttgatatttgaaaattttaacccttctttagtgacaccaacaaaacattcattctccacataaactatattcttcaccctttacccctcccgaagtaaggacctgccgataaatcaacatcctactatttcatttagtgttaatttctttctctcgaatataacctatgcgtcaattataaattatatatctagtctactgcaacgagctttcttggcccctaaatctaaagagagcgtgtattgaaatccaaggatttcgatacacgctctcgctttttaccacgtccccttctaacggagattagtttatatcgattggtttgctgaaatttacgagcaagcaaccgatagttttcgtctccttctggcggagatcagtttatatcaaatccaatttcgtgatcgccttaggcaaggaatagttttcgtctccttctggcggagatcagtttatatccgatcctgctaactttcttgctaaatcaaggataacttgacattttgatgcccacaattcgaccaggtaggtgctcattcaagcctctctagccctttttctggacattgtcaatttcgaatattaactctatatattataacttaactagttcagaattgaaattacaattccttgattttgaacccacattttcccatttcgtagagattttcgttattaataatgagaacgtgtcgttcaaatgagccatcctttttaggagtcttatagcgtactatccggctcttggttagcttcagggcaccattaaacttcatcttcatttttcttggagtttgacgtcgaatcccttcaatatcaacatgttgatggtcaactttgctccatagaccgctccctgctccgaggtatatgggtgctttgtaattcccctgaatgtatttagagggaaaagcagaaaggaaggttggtgcataattccgttcgtaaaactgtttagccatttcttcgaggttttcaattaagtagtgagcccttgcagtggttgtagtaattgtaaacttaacttttgtaaatggggttagcgattctcgaaataacggtagaggattcggtatcccttttttcacgctcacatcccacttctgacagattagtaagcgatcaaagggtattggttcactatcagaaactcgaatttcattaaagatatcatcaaccccatcctttgaattcccccacttaacattatccgtatgaaaatggcggtttactaaaatggtccgaattgctccttcgtacaatagccttaaaagttgtcactttaagaaacgtacaataccccttagggttgacactttaaataataaaagtgtcatctctagggggtgttttgaataggaacatattcaacgatggaaaacttaaggttactcagtaattaccaagattcagactacttactcggggtatacgcggattatcaccaggtgcggacctctagccttaacagatggattaaacaatttttaacggctggtttggctggattgattcgccctgaacacaatcacaggtacacacttcaaaccaagcgatcagccgttaaagcttacctttcaggtaccctgtcaggccaagtaattctcaatagatatcaaattcgtagtctttttcaactacatcaatggattgcccggtacaatagtggacaattaagtgttgcttacgcaacaagaaagcgagctaggaaagtgggccgaaaagttacttttgaggagaaacggcaaattactcaatggacaattgatcacgagtataactatcaagccgcggcagaaaaatttaatgtcagctatcaacgggtctattcatgggtacgaaagtaccaaagaactcacgattgggaatcccttcaggataaccggggtcgccataaaggcaaaataccaaccaatgaagtggaaagattacgacaagaagtaaggcagctgaaagctaaagcgaaggaacgggaggtacagattgccttcgcaaaaaaattggtcgaaatacacaatcgggaggtggaacggccggacgatatcaagcgattcaggaaatgagccaaagtgggtataaggtatctgatctagttaaagcagccggggtaagtcggcaggcttactacaagtggcttacccatgaaccgacggttcatgatattcaagatcaagaaattctaaagctcgttaaacagttagaagcacaacataaacactgcgttggttatgacaagatgacccgtttgataaagcaggaaagattatcatacacagttaacaagaagcgcgtcatgcgcattatgaaggaacacagtattaaagcggactatcgtcagcctaagagaaaacgtgtgcaggagcaggaaacttatgaagcacagaataccctgaaccgccagtttgaacaagccgccgcaaatcaggtgtgggtgacggacacgacggaaactgcctacaacattcgtaagtacaaagtccgtctacacgttgtcctggatctatacggtcaatacccacttggctggattattacgcctacagaaacgagtactggggctattaaagtatttcaaatggccaagcagaaagacggaggtctggcaccgctaatccacactgatcgcggagcagcatatacttccaaagcattcaaccactacttggctagtaataacagccaacatagttactcagccccaggaacactagctgataatgcggtgatggagcactggtgggctgattttaaatctatctggttagcacactcaccacaaccacaaacgtttgaagacttagaacagctggtgacagaaggtatcgattactttacgcattcctttatttcaggcaaaagaaatgaccttaccgcagcagaatggtactgtaccctgtcaaggtaacacttaaaaaaataaaaaattagtctatacggcctcattgcggaagtcctccgcggtgaggttatttcgcttgctggaaatctcgactgtgttgaagtactcaacaccctgcttaaccaaatctttcagttctgtcaaggtttgcggatgtggatgatgcgtcatccagatgtacttaaaatcgccccaatagtgctcaattactgcgttatcagccggagtaccgggcgcagagagactatgcttactattgttgctggttaaatagttattgaagtcttttgaagtataggcagcgccacgatcggtatgaatcaatggtgcgaaggtcccagcctgcttagcggcgcgtttaaaggcttcaattgcggcttctgctgtctcagttggtgaaatatgataactgagcacgtaacgaccatacaaatccaaaactacgtgcaagcgaactttattgttgcgaccataggttagttctgtagtatcggacacccaaaccagattaggcgctatctgaataaatttccgttccaataaattatcctcttggtactgttgttgttctttcttgcggctgcgctttttttgacggacatcagctttaatgccgtgtttccgcatgattcgacgcacacgcttaatattgatacgaaagtcaaacgaaaaggtgtattctggaatttcttgatttttcctattctcattgtttaaaatcgcggttacttttttataaccagcacagttctgatggcgtttttcaatctgatagattgcttccaaaattgccttgttctcaatttctctttgtgttggctgtcttttgagccactgatagtatgatttgcgtgaaactttggcaattttagtcagttcgctaacggaacctgcggtttcgttgattaattcttgaaccgcttgatatcgtccggtctcttcaccccccgattgcgtatttcgactaatttttttgcgaatgcgatctcaagctccatttctcgattgattttctttagtcttttaatttcagcttcaagtcgctctttttcggtcatctcttctaaagctttttgtggcttgcgatgcccgcgattatctttcaaggcttcccaactgtcagctgcctcatggtatttgtgaacccatgagtagacacgctgatagcttacattaaactgaatcgttgctccttggtagtcattgtcatggtccaagacccactgtacgattttgcatttctcttcaaaactaacttttcgacccatttttctgactcgctttcttgacttagtctttagttcatcattattgtactggatcgaccactgttttagttgagagagactacgaatatcatacttttcaatgattttttcacctgggaaaccggcttgatactctttgacagcttcaatcttggtatttagtaaatagcgatgattgagtgaacgatggcgaactcccgccaaaccatgcaagagaaactgccgaatccatcttgtcatcgtattctgattgacatgatgcatatcggcatatactttgaggccggattctgtcttttgatagccataaagcaactctagtctattcattgtcgaataacttgaaatgcaaaaacccccttaaggaaataacacttttattatttcaagtgtcacccttaaggggattatagccgaataccgctttggcaaggccaactagtttttattatttaatgtgtcaacttgacagggtacagtaccagccgtttttcgtctcaattgttgttatatcaatggtctttgtcaattcacaagtcgctcgtgaagaaaattgaaatcccttccccggtcaatagttagcttctttcacgaggctgcctggttcgtgaagaaaagtgatcaagtcccaaagttgtcttcaaccttgtgatttttacagttgcattcccagccaagctagcagcaagccgcccaggtaggaactggtgatgtataacagcgcagcgccctttctcccttcgtcaaagaggctaatcaattcgacgttaaaagtcgaaaaggtggtaaagccccccaacaagccggtggtccaaaacttgccactttcggccggtaagtactggctcaaaagcccgagggcaaaggaacctagtaggttgatcaccagtgtagccagtggccagtcgattcttgtcttcttccatagttgcgttagctgccaacgaagccaggcgcccagcccggcgcccacaccgatcatgatcattgtgccttccccactttcttagcgagccaaaagcccaggccagccattgccaggcccgccaccgccgtcaccaataggtaggccaggcccaggacaacattagttgataatagccccaccgttaccgtactcatagtcgaaaaggtggtaaaggcgccgatcaagccggtcccgacgcctagattgacccagctgggaaaggcgccccgttcaataccccagtacgtccaaaagcttaacaaaaaggccccgactaggtttactaacaaggtggcgatgggggttaccacaaccaggcctagtgccgcccgcaaaatgccgccgctaaatccgccgattagcacggcgctcccgtttttcatctattctaacctccatcggtctaatcaaattctaataataagtaagaacaagttgattgtcaatggcttagggggacaagtataattatgaatggaaaaattggaaaagaggaaattggttcaatgaagatgcgcagaattgaccatgtggtattaccggtggctgacttaaacgtcgcccgccgtttctatcatgaggtgtttgacatgccggtgctcgaccagcaatccacggatgacgtggtgaccttacggtgcggccaccagctgattcgcctggagaaggttgaccgggacagtgacctggtcgccactaagcttgttcccggtgccgccgacctgtgtctcgttgccggtgacgacatggacgccattgtccaccacctgcggtcctactttgttgacctagtggcgggtcccgtcgccaaaaacggcgccgaaggaccgatgacgtccgtttacctacgcgaccccgaccaaaacttgatcgagatcgccgtctatgaaaataaataatttggggtctattcaagcgcttttaagatcgctataatggatctcgttgatttttgagaaatgaggtgttacgaatggttgtaaccatgaaacaaactgccaaggcaaccgaagccacttacatgcgcaaggcaacgctggaggatttagaccggatctgggagatcgttgaagacgcccgcgcccttttgaaggctgatggtagcgaacaatggcaaaacggttacccaacccggttaaccttccaacaagatattgagtttggaaactgctaccttatgattgcaggcgaccggattgccggcaccgttaccctgatgccacagggcgacacccactataactacatcgttgacggggaatgggcgatgcctggtcacccgtttgcgaccattcaccggatcgccattgactcggcttaccgcggccgtcacttcgccaactacatcatgtcgacgatgatttccgtggcttacgcacaagggatccgcaacttccggatcgccacccacgacaagaacgaccgggtccacaacctggtccaaaacttcggcttcgttaagcgcggcaaggtctacacgggcccgacgccggacgacctgcgtaacgtttacgagttgaacttgaagtagaagtgcgaccaacctcctcgacaggtcgtatggctaagctagggcgaaggttggtgccctggcaccgttctttgcccgtacttagccactaggcctgtggttgggagcacgttattaagaagtgcgacccagccaactggtaggccgtgagctaagccagtacgtcggtttacactaaatttgaacaaacggccccccgctggacggggagccgtttttcatttcccccaaaacattctataatatagataataactagttgaaagggggcaccatgatggcaaaacaggaagtttcggcgaccaagcgcctgcgccaaatcgtcaacgtcatcagcaagaaccatttcctggccaacttctaccaccaaaccaacccggaagtgatcgtggccgccctggaggagttgggccccaccttcatcaagctcggccaactcctctccacgcggcccgacctggtttcaccgtcttacatttccgccctagaaaccctgcaagatcaggtccaagaagacgatttcgacaccgttaagaccaccatcgaggaatcgaccggccaaactttagcagagctgtttgccgactttgaaaaacggcccttcgcctcggcttcgatcggtcagtgccaccgggcccacctccacgacgggaccgaagtggtggtcaaggtccaacaccccgccgttcgccagctggtcgaagtcgacctcgccctcttcacccgggcggtccgcttgcttaagtacgttcccgagggcagcgtggttgacctgccccaggtagtcgaacaactgggccagtccctgcgctcggagattgacttcaccatcgaagcccaggccacccaacgcttttacgaactcaataacggccggggaattttcttggcgcccaaagcctttgtcgaccagtcatccagccgggtgttggttacccaatacatgccgggcgactcgatcaaggggctcttggccgacccgccgaccctagcccttcccgacggcctttccttaaccgacgttcgtaagggcgttgcccggtcactcgtcgaaaacttcatccaagaggtcttttacgaccgcttctttcacgccgacccccaccccggcaacctctttttcctgccggtgcccgcgggcagcacccaaaccaccacccagtttcaaaagcagtttggcgatttgactctgacgattaacaatcaaacgcccctaccgccttaccggctggtgtacctggacttcgggatgatggggaccctgccggctagcctagcccagggaatcgcccaggtgatcttggccattaccactaaggatagctaccaaatcagccaggcgattttacggatttgcaaccaaaccggcccgatcgacgagcagtcctttaaccaccagttggccagcttcttacgcccctacctcaacaccggccttaaggattacaacttctcccagatgatctttgaggtcaccagcctctgccgcagaaaccacctccaggttaagccggaagtgacgatgctgctgcgggcctttgggaccctggagggcacggtcgccaagctcgacccgtcgatttctttaatggacattgcccgtccctttgccaagcagtactttaaggagcactttaaccccaagcactttaccgaggggcaggcgctcaaactcttgcgggcggccggggccaccaccagtatcccgatccggatggcgaccttcttggagcaactcactaacggcgaacaacgcctaaacctgcactaccaggggcaagaccgggtgctggctaagctcgaagcgctgcttaaccgcctcttgaccgtgatcgtcttagccgccatcatcctcgcctcgtcgatcctggtggtcggcggcaccacccaccccctgatctacaaactgggggtcagtggttacctgctggcgatcatcatcttgctcggcttagtgattgccaacacctggcggcggttccaccgctagggcaaaatggtggcgtccgcttttcaaattggtctataatgatcaaaaaggaggaattatcatggcaaaagaattacctagttacgcaagcaaattgatcagcgtgcgtcccctgacggacgactacctcgaaatcctactcgaaatcccggctggtttcacctgggaggccggccagtacatgcgcttaggcctacccaccaaggaagtgaccgaccaaaagaaggtccgcgccctgtcctttgcgagcctaccggcggacggtcacatcctcttaggtacccggacccgccagcacggcgaaccttcttcgtttaaggccaacgtgcaaaccctggtgccgggcgaagaaatccaaatcctcggcccactgggcaagtttaccttaaaggacgaagacaagcccctcgtcctctttgccagcggggtggggatcacccctatccgcgccctggtcaaggaactccacgacactaagtcagaccgcccagtagaagtggtctacgtcgcggatggcttccacctctaccaagaggactttgaaaagtgggccgccgacatgccaaatctgaccctgaccctcttagaccacggtaaggacgccgttgcccacctgacggaactggcagaacaaaagggcaacgaggttcgttactacctgtccggttcaccagcgatcgtcgaatctaaccatgacctcctcgttaacgctggggtcgatgaagacctcgttgaagtcgacaagctgtacgggtactagcagcaagtggtgaccaaccaccctctcaataagtaaaaccggctaatccgcgtttctttgcgaattagccggtttttgtgttatctgagctgtaaaaacgattgcctcattttagtttctatccttagcccacggcctgccctatggctggatcgcacttccgataacgtggaaaatgaccacagacctagtgcctaagtacgggcgaagaacggtgccaaggcaccaaccttccccctagcttagtcatacggtctgtcgagaagatcattccccactccttgtgctttaatactgtgtaaactcgtggtttaagtgcatcaacaagccatccaaggcaccacgcaggttggcctggttgccgaagcgggcggccagcaagtcaggcttggtaacgtcggccagcaggcgcgggtcctggcgttggagcgcctcaaactggtagtcaatttcggccaggagactgggttgactgctaatgccgccccctagcagcacccggtccaaatcaaggacggcttgaaggttgattaacagcagggccacccgccggcaaaaggccgaaaagattggccaggcccggtcgtcaccctcatcaattttttcaaagaccgcccagccgtcgtgggcatccttgatcttgcaggcgaccgccacgtcttcgatcatcttgacggctgaagtcgtggcgccaaccgtggtcgcgggcgtcggttcatcaaaattggtgaccattgcgcttacctggccggtttgaaagtggcggccgctcatcaagtggccgttcagcaccagttccccaccaactgaggtgcccagggtgatcagggcgccgttttcgacccccttcagccgcccctgccacagttccgccagggtcgcacagttggcgtcgttaccaatgaaaaccgggcaaccacttgccaggcggatgtaactggccaggtcaaaggtccccatgaagctgagtgccccagtgaaagtcacggtcccttccattgggtcaacaatcccgggtacgctgaccccgatgccgaccaccgagtcctcaagcttacccaccaactggtccagtagcttcaaaaagtcctccttattggtcggggtggcgacgctgcggtgttcttgcatcttaccgccgcggtcaaagtgggcgtacttggtcgccgttcctccaatatcaatgctaaaataacggtgttccatgacagacctttcccttcgcttttctttttattatagcttgtttgcgcttccaattgaaagaaggttgttaaatgaacgacgattttctgcgtggctactaccagggcgccgtcgaaaccgccccggcgagcctgtccgcatacgatacagcgaccctggcgatgacgatggtggtccaacacctccgtcacaccaacttacccgaagaacggatcaccgacctggtcaatcacctgctcttcactaccgccggcgaccccaccacggcggcgcggttactggaattaaccaaggcggaactggagtccctcgccgcccgcttaatggccaaggggctcggcaaataaaaagagcccgcgggaatcgttttccctcaggctctgccattttcttgaactgtacaacattcggcgtcgatcatcccgggtacgcaatcgaacgggaccgcatccggcgccgttttaattttttcagctaggatggcttgcagctcctgcaggtctgccaccgacatcgttgaccgttcgactaagtgcctaatcgtcttgcccgcccgcatctggcacatggcgtcgaagagctggtcgacggcctggtccatcgtgttttgctccggaatcaggggcgtgtaaataaaggcccgcccctcctgggtggttttcagcgccccctttttaaccaaccgccgcagcaatgtcttgatcgtggcaggcttccagtcgacccgctgctttaaagcgtcgatcacctgggcgctggttacctggcccagggtccaagcgacccgcatgacccgccattccgccgggctgatgtccatttgttcgttcacgtcgggttccccctttccactccagtttacaagtgtacccgtcagctggcaaccgtttcggccgttaatcaaattggtctagttgtgaacttgagttagttgaccggccggcgccccgctttggttcgttccaattttacaaaagaagggcgttgctttttcaattaagcaaggccaccaagcctttaaaatgggcgtttattaatggaaattgggtgtggatttgctcagcggcttctcacgagaaacttagcacaatcttatcgccgctcccgataatctttgttatcataatcgtggaaacaagaaatggtttaaataaaaaggagtggtcatcatgatgtctacaatgagtaatgtaatcgcaatcgtcacctttgtcgctttaatcattgcaaccttaacccactcatttaagctgcgtcactaagatcgtaagtgggatacaacggaccggatgtaagactatgcgaacggttgtatgaaccgcaccgttcctcgccctacttaggcactaggtctgaggttggttacaccttagccgacaaatattcatcaatcaaaaacgggctggaagaaacaagcttccaacccgttttttgtgtagccaggggttaacctcaaccggatcttgatgatgtcgccaggcaccagggtggcagcgtcgatcgtttggtacttaccgtcccgtaaggcgttggcttgggggctattccctttttcaacgccaccaacgcgctggaggccttttgcgactgccagaggtcaatggttacgttgaaaatcaacagtagcatgatgataatgaagtcgtcccagtggccaatgatggccgaaatgatggcggcggcttcaatcatgtactcaattggccccatgaaggcatggagaaggcatggaccagcttgtgggtgaagctttcttccttttcctctagggcgttagcgccgtacttttgcaagcgggcttgcgcctcgcttgccgaaagcctagttttagcgtcagcccccaaatcttgcattacctgatccagcggggccttttctaggtcaaccccgctggtttttctgccatgttaaggccctctttctaatcttcgtccatgacaaagttattgtgaaagtaaatgttagcggggcccggggccgagtacttcaagagcggctcgtagcccgaaccggtttcccagcgttcaaattgccggggttcttcccaactcgtcagcatcacggtcgcgttgttatcgttgcgcgtgagcatcaactccgttttcacaccgtagtttttggcatcatccaaggcgttggctaaccgctgccgtagcaattgccgctcgcttttctcgacgttaaaggactgcaggttcactaagccggttaactgatcggcgcccacctgataatcgacccgggcgtcaaccccggcgttaaatacggtgtcgggacggttggacaagtcaaacaaaacgcaccggctcggatcagcgtcaacctgccctaagctaaaggtacggtcgccgtactgttcttgcatcgccgctaataaaccatgcgaccccaacgtgtaatgtaagtagatcaacatcgccgtcacttcctttatataaatccagttgatatccatcaaattattagttatctaagatgactaattttgtaattattattatagatagcgaatcgaccaccggttttaattagtggcaaatagcataataacaagggaatttgcaatactattaagctttattactataaagttgattattttcaattttccaagaaaacgggtacagtatggttaatcaagtgataatgaggccaaaaaaggtgaaatatggaccaacgattttggatatccgtaaagccaagaagatcagcttgaataatcttctgcaagaccaaatgaccccgtccagttacagccgcttcgtcgatgggaagaccgagacgttggtcaataacttcgtcgcactccttgaaaacctcaacgttaccttcgatgaatacctctacatcaataacggttaccaaaacagcaacggttaccaaaacagccgctacgaccaactctaccgcaagttaaccaccgctctgaaggccgatgacgccccggccctgatcgtcctcgttaaccagatcaacgcctttgcccagagcagccccgacaacttgcggatgaaaaacctcttagacatggcgatgctcgccctcaaccacgttcaaggcgacccgcttaacccaaccgccagagaggacctggtcaagtacctgattaattgcgaaacttggacccactacgagatcatgatcttttacaatttcatcttcatcttcgacgttgaaaccgtgatcgtgatccaaaagcggctgatccgggtcatctcccgctacgataacctgcgcctttacgggagcgaacccttccggaccctggttaaaatcaccatgttttacctcgagcacggtaaggtcttagaagcccttgaatctttgatggacctgcgcgactttgacatccaagaagagttcttgtttgagcagacgatgtacaagttcgtcgctggtgaaacctacacgatcaccaataccaaccgaatcaaggcgatcgacgacgccttaaatatctttcaggcggccgggtccacccaccaggtaaaccgactggtcgatcacataaagctggtcgtcaaggccaaccagttccacaacgatgacttcgacgctttgatcgaaaagtggggcggcaccccatcgacgaagacaccgaccaccaccaccgtttcctaacccctccccagtgacggaagattccgtaaccggggatttttttgtccccaaatgaaagcaagcctggtaagggttttgggaaatccttttcctaaaattgccaaaatgggtgttgacagcgttttcaggagtggttagtattggtgtatcgataaaccagagcgctttcatcagctgctctcatcgaggaggataagagatatggattatttgattggtgttgacgttggtacgacctcgaccaaggccgtcttatacgatcaacaagcaaacgtgcttcaggacttcaagcagggctactcgctgtaccgggacgccagtgggatggcggagcaaaaccccgacacactggtggaagccgtccaaagcgtgattaagcaggcggcccaggcggctaaccttgaccaagggaaactcttagcggtttctttttcttcggccaaccagagcttgattttgctggacgacaagcaccagcccctaacccgggcgctgacctgggccgacacccgggcctgtgcggtggctgaccagctcaagcggacgccggctggtaagcagctctacgccagcaccgggactcccattcacccgatgtcgccgttaaccaagctcttgtggcttaagcaggcccaccctgatttgatggccagggctagctactttgccgacattaagtcctacctgttttacaagctgtttggggtcttcaggtttgacgtctcgatcgcttcttgcaccgggatgttgaacgtaaccaccggtgactgggacgaacgcgcccttgcgttaaccggggttcaaccagagcagctccctgaagtcgttagcggaaccacccaggaaattggcctgctccctgacgcagccagcgcaatgagcattcccgcccaaaccccctttgtctacggggcctttgacggtgcgctgtctaacttaggggtcggggcaattgaaaaggacaccgtcgccattacgattgggacttcggcggccgtccgggtggtcaccgatcatccagtcattgatcctaagcaacgcctcttctgttacgccgttgataacggcctctgggttgtcggtggccccctcaacaacgggggtgacgtcttccaatgggcggtggaacacctagtcgatgcctccgccgtccaaaacgaacaagtcgacgcctacgaactggccaacgacgtcatcgcctcggttccggccggggctcacgggctcttgttccaccccttcttaggtggggaacgggcaccgctttgggacgccaacgcccgcggtagtttcttcggtctttcccaacttcacacccgggccgacatgctccgagcggtaatggaagggatcaacatgaatattgcgaccgtctttaccgccgttgccgacctggttggcgagccgcacacagtaaccgccaccgggggctttgccaactcggaagtttggcggcaaatgctcgccgacgtcttaaactgccccgtcaacatcccgaactcctttgaatccgggtgcttaggggccattacgatggcgatggtgtcgttagggatggttgacgacttgagcgccgtgactaagttggtgggggaagttaaatcctaccaccctgacctaacaagcgtggccacctaccaaaagtacctccccgttttccgccaggtggaaggacttttgtcgccagcctactctaccatcgcgaacttgcaggaagattaatcatttaggaggattaattccatgccattattaattgttttacttggtgttatcctgttggtcttcatgatcgtcaagctgaagcttaacacctttgtttccctagttgttacctcgtttgtcattgccctgctcctccaaatcccggtcgctaaaattccgaccacgattgaaaccgggatcgggggccaattggggcacttagccatcatcttcgggtttggttcgatgctcggtaagctcgtttccgattccggtggtggttaccggatctcgacgactttgatcaataagtttgggcgccgctggattcaattagccgtcattttggcctcctttatcatcgggttggcactgttctttgaagtgggactggtcgttgtcttaccgatcatcttcatcattgcccgcgaattggatatgccgctgatgtatctgggggtcccaatggccgctaccttgaacgtgacccatgccttcttgccgcctcacccggccccgacggcaatcaccgaaatcctcggttctgaaatcggccacgtcctcttgctcgggatcatcgctgccatcccaaccatcatcatcgccggaccggtctttaactgggtgctccaacgggtttacccgaaggtttaccgcaaggacatcgacatttccgtgttaggccactacaagaccttcaagctggaagaaacaccgggctttgggatttccgttttgacttccatgatgccggttatcctgatcatcatcgccaccctgtgctctttcaccctgccaaagggcaacgtagttaaccaagtaattcaattcgtcggggcgccagacgccgccatgctcttgtcaatgctgttcgccgtttacacgatggggatcaagcggaacaagaagatggacgaaatttccgaatccatggtggcctcggttaagcaaatcgccatgatgctcttaatcatcggtggtggtggggccttcaagcaggtcttagttgacggtggggtttccaactacgtttcgaccctcttcgcccacaccagcctgtcgccaatctttgccgcatggctgatcaccgccattctgcgtgtttcgctgggttcctcaacggtttccgccatgacggccgccgggttaatcgccccgatggcccaccaattcggtcacggttccgccatgtccgctttgatggtgttggccgttggtgccgggtccgtcttctgcgaccacgttaacgacgccggcttctggatgatcaaggaatacttcggtctttccttaaaggaaaccttcctttcctggtcaaccttgacctccgtcttatccctggccggattagcaacggtttacggcatgtcgctcttcttagcttaattcactttttctttccggactcaagccattgtgcttgggtcctttttgcttttgacaatcactcgcccatggagcgttgcatcgtggtaaactaggtttattagtcttacaagggggagttacaaggtgcgacgattaacaattaccgacgtagcccgggaagccggggtttccaccaccaccgtttcccgttacttaaacgggcacttcgaaaaaatgggggaagaaaccaaggagcgggtggccaagaccatcaagcggctcaactacgccccgtccgcctcggcccaaaagctccgtcaaaacgaaagccacctggtgggggtattggttggtgaaatctctaaccccttctcttcgctgctttccaaggggatctacgacgttttacagggggccggctacgatattctcctgatgaacgccgacaactcaacggcgaccgaagcccgggccctgcagcgttttgtcgcccaacaagtcgatggggtcatcgcccagcccagcgccatccattttagtcagttccaaactttgaccgatgccaacatccccctggttttagttgaccgggaggtaccggaccagcccgccaccgttggccgggtgacctccgccaaccaggacgcctgttattacctgggcccaaccctagtggagcgcggctaccaaaacatcatcaccgtctcggcccactttgccgaggcatccgggcagatcccccggatcgccggtttccaaaaggctagccgcacctttggctttaactactccaacattgaaactaagggtcacgacaaagcctggctgcgcgccaccctctcccatcaattagcccgtttgactgggcgcaccgtcatcatttccctaatggggccggtcttgtttgacctgctcgccgtctttaaggaactgaggcttaagttccctaaggacgtggggctggtctcctttgatgactgggagtggtcccgctacgtcagcgacgacgggatcttcttgttacgccaagacatggaattgatgggcaacatggctgccaccgccctgttaaagcagctccaaaccaagaccttaacgagcccaaccaccctgctgccggtgaccaccattgaccgcccatcattataaggggatgataaaatgatcaaattaacggtgactcccgctgccgccgactggctcaaggaaacccttaaactggttgtcggaaacggagtcaagttttacccggacccggataaccaccacccggttattcatgggccgcaccaactgtacgccatcgataaccaccccgaccgcgtggtagctaaagacgaggtcagcggtattaacttccacatcaactttgaagacgagtggttctttatcggccgcgaaatcacggttgattaccaagccactgacggactaacctttacctttagcggtaacgacgccaacgctggcgccaccatcaactacgaaaagtttctaatgtaaggatagaaagtgagatagaacctgtaattctcggtccctgcttctgtctaggattcaaaaatataattagcggcggagagaaacgacttgtttttctccgtcgctttttgattgacgttagcaagtgaatggtttaggctggttgctggttttttattggggtttagttatagtaaatatctgcttgtccgttaatgctaaaaaaagaaccgcgggattcgttcccacggtcctaaattaagctgtctttagtttacttttggtggcgtttgataaaatccccaatccgcttgatcgcttcctggagggtcgccaagtcggtggcataagaaagccggacgtggccgtctaaaccaaaggccttccccggtacgatcgagacgtgggcctcctctaagaccccgttgacaaattcgtcagtcgactgaaagccagtcagttcaacggcctcggaaacgtccgggaagaggtaaaaggcccccgcccccttagtaacgctcacgccaggcaagtcgttgatcagtgaggtaatcgtgttgagccgctcttcgtatgcttggcgcatcctttcaacttcttctttcccccgcgggtcggtcagcgccgtcagggcggcgtactggctaacggccaccatgttcccactcacttggcctaggtaggtacctaaggcagcggcaacgttgcttggcgccaccgcgtaacctacccgccaaccggtcatggcgtaggacttggaaaaaccattgaccaagacggtgtggttaaccacgtcttcacccaaatcaaggacggaggtgaactcggtgccgttgtacactaggtcgccgtacatgtcgtcggctaagattaccaggtcgtggtcgaccgcccagttgacgattgcggttagctcgtctttggtgaagacctccccgctcggattattcggggtgtttaagaccagcagcttggtctgcggggtgtagacggcttcgaggtcttccaccgtcaccttgagcccttggctggggtgggccaagacgggcttggcgccggctaatttaatttgttcgccgtaagaaacccagtacggaagcgggatcaacgcctcgtcgccggggtttaagagggcctgggtcaccgcatacagggcgaacttgcccccgttagtaaccaccacgtcacgggcgccaaagtcggtcccgtgctgttcattaatgtggttggcgatcgccttgcgcagcggtaagatcccggtggctgccgtgtaggaatcggcctcgtgttcttcaatcgccttgatggcggcttggccaatgtaggacggggtcttgaagtcgggttggccgaccgccaggtttaagacgtcgatcccctgggcggccatttccttagcccggttagaaaaggccagggtggccgatggttgaatgtttgcgatccgttctgaaagttccacgattaatcaatcctcctggtgtttaactgccaaaatgcgaacaaaaaatgcacttcatggtcaaattataccatcttaccacagaaaccgggaggggattttaacacggagccaaaaacgggaccgggagaaaaacggcttctcccggccccggcggttctttttaactgtgagtcagcccgcccagtcggctcccctggctcacagggcaaagggcctgactaagtgggtcagcggggtgtggtcagacactttaagcaccaagtaaccaccaaagacgccgagggtgttgctgatcacgtcgtcaatatcaacgacccggtttaagttaaccgctagatcggccactagttggcaggattcaatcgctaagcccggtagcgcacagagtaagagaaaggccacgggggagaggttcggtttcgctaggtacaggtagacccccagcgggaccgtcatcaggatgttggcgtaaaattccgcgtcgacgtaggctaaggggtgcaggttgtacgaaaccgtaccaaagtaagagagcggcttatcgagccccgggaaaaagggcatcccagtcgggtaaaaggttagccagattaaaaccgctaagtagcaaaacccggagctaaccgtgatccactgggccgcccggtaacgttgcccggcaatgcgcccccagtaaacgacgccgaggatcagcagtaaggttgctaacggtaaccacctttgatgcatcatctgtccttcctcctttccagttattaggttttattataccggttgaaccatgataaaccaggttttacaccgatcgttagcctttcttattatttacgccggttaatttgcatcccgatcaaggagccaatgataaacaaaacgaccaggactaggataaacgtaaccacactaccaccgcctttcataacgtttcgattgtaccgatccagccgggcggggtcaatcatttttaaaagttgatggtgaaatcatgacctaacttgtataatgttttcaaacgtcacaagagagggtgatttgatggaatcaattgaagcgatcattcaacaacagcagttagcaggtaagttattcggcggcttttttcggcctggaagtcgagcaacaccgggttttaataaatattggccggaatcccgtgactttagtcatgggatggataggcttctacttacgtcctttagggcgtttttttatttcattgtacttttgattattgatatattgctcaacgacctccttgctcatattccctaaagtactcatgtaatagctaggggaccagaggtggccaccccaatactgcgactggcggatttccgggtgtcgcttgaggaaaatgaaggcactgcgtcctttgagggctttgatagcgctagttggtgctttactaggtggaaaactaatcaacacatggacgtggtcaggcattacttccatgtgctcaatcacgatttcgttatctgccgcaaccgttgtaaggatttccttcatttcattcactaacgcttcactagtaaaagttggattacgatacttggttacccaaatcaaatggtagtgaaagttataaatataacgccgtgtataaatggcatcttcgattttgtccttcgacatgattgccacgctccttaattattattatcattgacatatggtataatagcactatatcagtgaaggcggtgaaaataaatgaagtcaatggcgcagatgaaatgtcattacggactcaaggtgcggatttatccaagcgacaggcaaaagaaaattatcaagatcaatagtgatgctagtcgattcatctataacgaaatggttgcgatcaataaggaactgatgcagcttcgcagagttaagctgccgattgacatagttcaggatcgtattaagcaactaactatgcgccaaaacgctaagcaaatgtctaatcactatcaattcttagaagataaacgaattgatagcttgactaaagccaatgccattcaaaactaccataaagcttggaatgcttttcgcaaagttcataccgcaggtgtgcctaagtttcaccggaaaagttacgtctggcgttatcaaactaactgccagtatttgaaacagaaggcagcatacttaactaacggaactgtacattttgaagatagtaagcatgtgatagtgcctaaattaggtcggctccgtgttaaaggttcccatcaacgagtcttagctcgcagtgctgaaacccgtattggaacggtaaccatcgtaaaggacgctagcggtcgtttctttctctcaatgcagttagcgtcggatactccctttgtcaattggccgcaaaatacaggcaagcagattgggattgatcttaatactgaaaacttcttaactactagtaatggcgatactgtggctaatccacgctattaccgcataattaagggtcgcttagccaaagcacagcgcatcttatcgcgacgggctcgtcgggccaaacaagaacatcgaccattacggactagtaagaactaccaaaagcaacgcttgttggtggctaaattacacgcccaagtctttgaacgtcgacgtgactttctccacaatgtctcgactacactaatcaagaaccacgatttcgtagccgcagaggaattgcggagtaaaaatatgctgaagaatcatgctttagcgatgagtattgcggacgtaggttggcggactttcttaggaatgttggcttataaagcagaactctaccatcgccaattccttacggtgaatcctaagaacactacgcaggcttgccatgaatgtggttttgtaatgggcacagcagggaccgaaaaactcacacttgcagaccgagaatggacatgcccaaattgccatgctcaccacgttcgtgaccataacgctgcgcagaatattctaactaaaggaattattaaattagcctaatttggctcgtccctatggcaacctggggacgctaaaggcattggtaattgccgtgtaagacgaaacggttcgtagaactgttcgcagtggtgtatctatgcaaattgtgattcaaacactcatcagaagggtgcttgctcacaagccactgactttagtcagtggtggttgacagaccgatttttgcgataatatgtttgaactagtggcgccccccgttcaaggggccacggcggcggtccaaaacctcaagtacttgcaacaaattgtcaatgaccacttggcagcagacgagcggagctggcccctgtcgattatggcgcccctctccgccgatgacctagcctttgccaccaccttcaatacccgtcagtggatggctgactaccacgactacctgggcgcaaagtacgggattgcccgggaactgatggccggcgtccacgtcaacttttcgctccaccgcgacctcatcgccgccctctttgcggccagcgggcaaagcgatttagcggcctttaaaaaccacttatacttccgcttggcccagggctttgtcgcccaccgctggctctttacctacctgtttggggtcagcccagtgctggctaacccactcaaggggatgccggataacctcgccttcccggtccgcagtttgcgcagtagtgactttggctacaccaacttccccagcgaaacgatcacctacagttctttgggtgcccaactcgaccaactcaagcgcttcgtcgccgaagggaagttctactccctgcacgaattctacggtccggtccgcctcaagagccgcggcgctaactcggacgacctgattgcccacggaaccgagcggctcgaattccgggcctttgacctcgacccgctttcccgggcggggatctcaaacgataccctcaacttcttggaggtcttcttagcctactggctggttgccgaccaggaggctgatctaacggaggccgacgagaaaaaccaagccgtcgccctccaacacccccaccaagaattcgactggaccaaagaacgcggactggccctgttagacgacctcgacgccttcgtggctaagtacggggcgccaaaggaataccaggccgccctgctctttgcccgccggcgcctggaggatccgcgcctgacgatcggtggccaattaatcgacaaggccgatcccgacggcggcctactttcttacggcctcaagattgccaacagccaccacgactggtacaagtccatggcgtatcccttacagcctacgatcgccacttaccccgccccggcccaagaactgatcaaggcggccatcgagttggggatcaaggccaaggttacccaaaattcctttgccctcattttgggcgatcaccaagaacagtacgccgctaaccaggcctttgacctgacgaacggcgccaaacaaacggtgctggcggccttccccgaacaggtcaactacaccgatcaagtcgaccaagttcaagtctgaggaccagctagtcggggcgctgccggtttaaccaggaaattaattgaagtgctttcagtaggtgcctataatggaactaaaacttactaaaagaaagttaaaccaaaaggatgatcttgatgaccaaagtattactaattggggcgaccgggatggtcggtcaagaaatttaccaagccgccactaaggccggactggccgtcaccgcccaggtccgccatgccgacaaggcacgggaactgtttggtaccggcgtgaccgttttagaacaagacgccctgaccctgtctaaggacgaactcgccaacttcgacgtggtcgtcaacgccttttcaactagccccgccgaagccgacaaccaccaaaagctagctgaacacctcgtccaccgtctcggcggggatcagcggctcttggtgatcttgggggctagctcgttgttagacggcgccgacgaccacctggtggttgatgacatcaaaaagacccccggggccgacgcttggatcgccatccccgaggggcaaaaaaaggagctcgactacctgcggaccgtatccgggattgactgggttggcatctcgccgtcctacaccttcaaaccgggaccggcgagcgaccagatgctcgtcggcaacgaccacctgcttagaaacgacgccggggaatcctataccaccgccggcacgatggccaaggcaatggtcgcagagatcctccacccggcccaccaccgcgaatgcttcacggttgctaacagctaactaaaaaggacaccaacaattcggcaaacgaattgtggtgtccttttttcgttggtctgtgtaatcagggggaatcactgttaacgggcctcgggggcgtttcccactcacctattttttaatcatcattgctactgaagatcaccattttagccatgataatctcccggtaaaggctggtcatcgccgggcggtacttctcctctagttgagtcaccatcgctaggtagccgcactcctcttgaaaaaccaaccggtacgcttcttcgaggagctggcgctgttctatggggagggctggtttggcgacgacctggcggacctcctggatgaactggcgggtcgttgtgttagcaatttgggcgttcaagtcgtacagcacccggcgccgaaggtcttcgggcaagtaaatctgcttgatacgggcaatcgcctggttaaccatcgcctggcggaccttggtcacttccccttctagtttggtgtcggtcgtggtcggctttaagatcaaccgaaaaactgccgttggatcacaattgaacataccacggctaaaatcaacagcgccgttgaatacagtagtaccaccaatatcaacctcccgttatcgtcctcaaattataacccacttcagcgttcagtcgatattgttttgacttgaaacaatgctaaggggcccggaaaaagccattcctttccctgggccccttattttgattggcaaacgttagctcaagacgtggtaactaacaatggggggcgtttccccctgattacattttcttccaaatctcctcgtcaaagtagccgaggtggttgacctccagggtctttaggtaggcgattagttcaatcgcggccgaggcgctcagttggttaacggcgtttaagccggtcccaattggcaccacgttgctcatcgccaccacgtcggtgccgttttcaatctgcacctgagaaaaggtgatcgaccaccgtccccgcatgttcggggcaaagacaaagaagaggttgtaatcgtcggctaagtatgccggcatggcgtaggcaacctcgtcgatcggttcgggcaagaggttgccctgaaaggcgaagtgatcaaggttaaggacgttgaccgggttattaagcataaagaccgtgttttcaaactcgggccggccaagtttcatctccggggtaatggtatcctttaagcgcatcagattctcctaactgaagttggttcggtaaaattcatacttttggtgaatcgactggaggggttggtccatcacgtgttcttccccttgatcatcaaccaagaaacgctcgcggaccttttgggtaaactgcagccgcactaggggtgccttttgaaagacttgctccaggttggtccccatgatcgccaggtggtcacaataagtcggcaccagcatctgttcgaggtcaccaaacaagtcggccaagacgtcggcgtaagcgcgatcggcgtagtggcgttcgttctcctccaggcggtcgtagtactcgacgttggtgagccccttttggttttcgatggcgtgtttctcatcgtactggtgggttaagtaggaatcccaatcgcggtaggcgtaggtcgtcaggtgtaagaccaaatcgcgcccctttttagtgacgttttccgggaccatcccccccttaggatcctttaggtaggggcgtaccagttcaagcgctactaggtaataaaaggtccccggcaagagttcttggtcttggtcaggtgaataaaggggtccctctccttccaagagcggtaggccaataattgataaacgggtttggttgacggcgtagaccaggtcctcaatgtcttggtcaatttcatcgcgcgccgagaccgcctgtaagacgtgggtgaagaggcgggagagttcgtttttctcctttttttggttgggatagtaaccagcttggcgctcgtacttccgggtgcaacgctccagttgctcctctaaggcggtcgccatccgttccacttgcaccggtagggttggctctttcaccccttctttggccacctggcgaacggcttcgcgtaggaccggccgcatctcaatgaagtctggaaagtcaaagacgttttgaaagtcgtaatgaccactcggatcgacttgtactgggttcagctggtaattaaattcagtcatggtgtaccccctttttaaactagcttaccaagtcccctgccgccaatccattagggaaacaactaaaaatagccgaagaccgacgcctgaaacggtgtgatcttcagctattgaattggttattgaatactcactcgactaggaaagcttcgccgttgggcgcttttaaaccaacttggtccgccggcggtaaacgataaagcggcggaagatgtattgccacggcgaagatgtattgccacggcaaggttaaggcgtgcaccagccgggtgtacgggaagtaaccgaagacaaagaaaccaactaagacatggatccggtaaatcaacggaacgtttaacattaactgccactgcgggttcagggtgaagaggctccgcacccacggcccgatcgattgacggtagttaaagtcaatgaaggcaccgtaaatcgtgcacgacatcccgagcgtgatcgtgatcaacaggacccagtcaactaaaatgtcgttgatgctcgaggtcttgtaaacccgggccacggtcatccgccgccaggttaagatcgccatcccgatccaagccaggctaccggccggaatccccatcatcagagaaccaaacatgtggtacatgtgttccgtgatgccgaagtaatcggtccaggcttggggaacgagcatccccaagcagtgaccaaagaaggccatgatgatcccgatgtgaaagaggatgctcccaatcatcagtttcttcttttcaaaaatttcactcgacttggccgtgatcgacccgtgaaagtacttaaaccgaatgaaggtcccgaagaaaaaggacgccaacatcaggtagggataatatacccacagcaggtgggcccaagcgttatgcatgtgcgttcgcctccgtttcaacgcaggaccggattaggccccgcaccgctttgattagtttcatgtacgggtcgtcggcgtcggctagggcgttttgcaagagggagtaggtcccgtcttcaatcactcccagggcgagcttgaggtcgtcttggcggctgtcgtccatgaagtcgccataggcaaagaactctaagagcatcggcaagtaatcagccagctcactggtcgtctccgccacgccgaacatttcgtacatcattttgagtttagcaaggatcgtcccccgctcgcgggagtcagtcatcttgtaataagacatgtaaagggtgtagcgccggttcatttcaaacaggctggcaaagtggctctcctggtccagcaaggttccttggtttaactcatcgaagagctcaccaaaggtcacttgttgctccttagatagcgccgggttttcgaccagggccgccctcatttccggactaaaggtctcctggtcgggataatcaatcaagcgcgacagggccacgaagacatcctggagctggttaatttttgcaaagttaatcacgccaaatccccccgtagaagctttctgcgtaaatttggttggttgattcaccagcttcggccttcttaaacatactggagtgttgtggtgccaaggcacagccttcacattcatcgtaacccagggtcccctgttcggattgtgcgtcttcgaactgggacttgttggattgcggaatcacaaagcggtcttcgtacttagcgatcgccagtaggcggtacagtgaagtggccgagttttcggtcaagtcaaccttagccaacttagtggtatcgaagtcttgaccggccgtcttcgcccgcatgtaaagccgcatcatagccagcttgtaaagggcctgcttgatgaccggtacgttacccccggtcaaaaggttggccaggtattcaaccggcacccgcatctggtcaatacccgggaagatcatttccgggttcttcattgaatcccgtccttcaaagtaggacatcactggtgacagaggcggaatgtaccaaaccatcggcatcgtccggtattccgggtgcagcgggaaggcaatcttttcttcgaccgccatccggtagatcggtgacttttgggccgcttcgatcatttcctcagagatcccttcctttaaagcttggtcgacaatttccgggtcgttggggtccaagaagaggtccaattgggcttcgtaaagcttcgtttggtccggcgtggaagcggcttcttccacccggtcggcgtcgtagagcatcgccccgatgtagcggatccgaccgacacaagtttcggcacaaacggttggcaacccctcttcaatccgtgggtaacagaaggtacacttctctgccttgtgggtcttccagttgaagtacaccttcttgtatgggcaaccggtcatgcaaaaacgccagccccggcaccgttcctggtcgaccaagacgatcccgtcttcgtcacgcttgtacatcgccccggacggacaagaagccacacacggtgcgtttaagcagtgttcacacagccgcggtaagtaaaccatgaaggcctgctcgaagttcttcttgatgtccgattcgatcttttgcatgttcgggtcctggttaacgtattccgttgaaccagccaggtcatcatcccagttcggtccggtggttaattccatatccaaaccagtgatttgcgactttggccgggccactggttggtgctttttctccgggccaaacagggtcttgtaatcgtaggtccatggctcgtagtagttgtctaattcgggcatgtcgttgttgtaaaagatcttccccagggcgatcttgttcaacttgtttccggcctttaactccaattttcccttggaatttaaggtccagcccccgtggtattgttcttcgtcttcccagcgcttagggtacccgaccccgggcttggtttcaacgttgttaaaccacatgtattcggccccgggccggttggtccaggtgtttttgcaggttaccgaacaggtatgacaaccaatacacttatcaaggtttaagaccatcccgatttgtgctttaatcttcattccagttcaccttctttaactttcttacgttcgcgtataggtcccgctggttcccggttgggccgtagtagttccaaccgtatgacaactgaccgtagccgccgaccatgtgggtaggcttaacgtggatctgggttggggcgttgtgcgagcccccccggttcccggtgatcgttgacagcggttcgtagatttcattgtcctgggcgtggtacatgtataaggaacccttaggcatccggtgggaaaccaccgcccgggcggtaacgaccccgttccggttataaagttcaatccagtcgttgtccttgacgtcaattgcctcggcgtcttgcgggctcatccaaacggttgggccaccccggaagagggtcagcatttccaggttatcgtagtacatggtgtggatgttccacttcccgtgcggggtcatgtaacgaagggtgacttccttgtcggcaggggtgacctcaacgtcaccaggtcccatcacttgtggtggcaaggacggcttaaaggtcgccaacccttccccgaagtcgaggaagatttcgtgatccaagtagaattgttgacgcccagtcagggtttcccacggttggaggcgttcaacgttcaaggagaaggccgagtaacggtcaccgttgtgcttagcagaggtcccaattggggttgggtaagcctctcgcggctgggcggtgatgtttttaaaggtcatcttggcttcggcgcggccacggccaatgtcggttaacttttcaccagaggcctgttcccgctttttccaccccaggtcagccaagcgcccgttggaggccgtcgacatccgcaagacggcgtcacagaccttggtgtcttcgtctagcattggtaagccagcgttgtagccatcggtgtaggtccctagctcatccttaagctcttcaatttctggggtgacgtcatagccgtagttagcggccatgcttgggcccagggaaacgtactggtcgtagatgtggtggtagttacgttccactaaagacattgacggcattgtcttgcccggaattggctcgcattcgcccttcttccagtccttgatttggcccagtggctggctgatttcacccggcgtcccgtggcccagtggctgggtctttaagtcgtaaccagtttccggtaggtacttcttggccatttgggtaaaggtcttagccaagagcttaaactgttgccaatcggagcgtgattcccacatcggactgatcgccttgttgaacgggtgaatgtaagggtgcatgtcggttgacgacaggtcctctttttcgtaccaggttgccgccggtaagaccacgtcggagtacatagccgtcgaaaccatccggaagtccatgtcgacaaccaggtcaagcttcccagtcgtgtcctcgtcgtgccaaaccattgactccggcttcaagcgggtgttggccttggccaagagcccgttttcggcccctaaaaggtgcttcatgaagtattcggcccccttaccagaggaggcaaacaagttggaacgccataagaagaagttcttcggctggttttgcttggcatccgggtcttcggcggcaaagtgcagggtgccggccttaagttcttccaccacccgcttcttgatctcttcgatgtctttagtttggtaatcctcgacaaaggacagggagttgcggtcaaactgcgggtaggacggtaaccagccgaggcggatcgccatttgaacgtaatcggcgttgtttaagaaacggtggtcaccctgataaaccggtgaatactgctgccggttatccatttcttcgtagcgccattggtcggtggcgaagtagtaccaagtcgtcccctgttgttggcgggcaccaccctggtgccagtcgttagcgaaggtgatgttggcccacccttcttggggccggagcttttcttggccgacgtagtgcgcccagccgccaccttgtaccccgatgcatccacacaacattagcatgttgatgatcgcccggtagttcatgtcggcgttaaaccagtggttaaccccaccacccatgataaccattgactttccgccggtatcgagggcattttgggcaaattcacgggcgatctgggtaactagttccggcttgacgccggtatattgttcttgccaggccggcgtgaagaaggagttggcgtcgttttcgtcttgggcggccagttcgtcgcccgcccgacgcttaaccccgtattgggcgagcatcaggtcgtaaaccgtggtcaggtagtgggtcgaaccatcggcaaaggttacctcttggaccgggatgtgacgtgccacgaccgaattaccttcgttagaaaaggccgggaagtcaattacaacttccttagttggcgttacctggtcttcaacggacagcgccggatcaatggcgttgccagcggcgtcctttaattctaggttccactgggtgccttgatcgtaatcctgtcccagggtcccgttcggcacaacgtagcggttggatttggtgtcgtaaaccaccgtcttccaatcggcgttggtcacggcgtcgtttgtcaaatcgttgattcgcacgtagcgtcccgaagttaggtggtcattgccggccgccgaaggaattaattcaaccataaacggcaggtcggagtactgcttggagtagttaatgaaggcctgctcgtggcgcttttggtagaactcgtttaggatcacgtaggtcatcccctgagcgacggccgagtcgctccccggttccggtgccaaccagtcgtcggcaaacttaacgttttcggcgtaatccggactgacggcgacgatcttggtccccttgtagcgaacttcggtcataaagtgggcatccggggtccgggttaacggaatgttggaaccccacataatgatgtaagaagagttgtaccagtcggctgattccggcacgtcggtttgttccccccaaacctgcggggaagcaggcggtaggtcggcataccaatcgtaaaaggacatcacttcgccccccagcagggataagaagcgcaccccagacccaaacgagatcattgacatggccgggatcggggtaaagccggcgatccggtcgggtccgtaatttttaatcgtgtagatcaaggaagccgaaatcaattcgagggcctcagcacggtgaacacggaccattcccccgtgcccccgggccgacttgtattccttggccttttgtggatcttcgacaattgaggcccacgcgtcaatcgggctttcgtggttttgcttggcgtcttgccacatcttccacagccggccccgaatgtatgggtatttgatccgcaccgggctgtactcataccatgagaagctggccccccgcggacaaccccgcggctcgtaacccgggatgtttggcccacacgatgggtagtctgtggcctggtgttcccaggtaatgaccccttgcttgacgtaaacgttccagctacaagaaccggtacagttaaccccgtgggtcgtccgaacaaccttgtcgtgggcccagcgctgccggtaaagcttttcccagcgccgtgagttttcttctagctgggtgaaggtaccgttgaacttttcaaccttgtgaaaaaaacgtgacttaatcactgttatccctcctaaaaatgtacttggcccactagtgcttaataaagtaagccatttccctaataccaacactagcacccaaattgctatactacgactagggaaagtcctatatttttaataaaggaggcggaaaccatcgaccgatacgaccgccaacgccgggtgacttccatcggagcagccggtcaagaaaaaattagccaagccaccgtcttagtggctggttgcggcgccttgggttcttacgttgccgagcaactcacccgggccggcgtcgcccacctgattttagttgatcccgatcaggtgtcattaaccaacttacaacgccaggccctctttgatgaagacgacgttaagcaacaccgtctcaaagtgatggccgctaaaaaccaccttaaccaaattaaccacgaggtcgaaattacgccgctgccggccccactctcgattgacttactcaacgagttagattttgacctcgtcattgactgtttggataactaccaggcccgcgacctgattaaccaagcggcctgggtccatcagttttcttatgtctttggctcctgcgccggcaacttcggtaacgttatgttaattgacccaagcaaggggccttgtttaaacgacgttttcccggatttagaggcgctcaaggccaccgattgcgacttaatcggggtcaccaccccgttggtaccgctggtggcggccaaccaggtcagcctggccctccactacctagtcgacccggcgacggttaactatgaccgcctgttaacaattgacgcttggaacggcgacttcaactacttccgcgtccaaaagcgaccggattgcccagtttgcgccaatcacaagctaacggttgaaccagacgtcagcccgcaagtccgcgtcctgtgcggtagccaaacctacctaatggacctaaccgaacgtcttgatttaaatgacctcgccgactggttaacggatcgccaaatcgaagtcgaacaaagccccaagttcatccactttacctttaaccaaaacgaactatccgcctttaaaaacggccgtttgatcctctacggggcccccgacctggcggacgccgaaaatcaattcgaccgctttttagccgtcaccaaccacttaatgacccagtagaaaggagcagatagtagtaccatgttaacagccaccattttaaccgtctctgacagccggcacctggcagaagacgggagcggcgccttaatcaaggcccgcttgctagaaaatgacgttacggttattgaccaccggatcgttgtcgatgaccaagttcaaatccaagcagcctacttaagccaagaattgatgggcgccgacctgttaatcatcaacggcggaaccggggttgcccaacgcgacgttaccatccccgccatcaccccgctcttaacccagcaaattccgggctttggcgaggccttccgggcgctttccttcaaagagattggcacccgggccctggcctcccacgccatcgccggtttcaacctgtacaaccagttgacttactgcctaccgggctccaaaaatgcctgccaaacggccctcgatcagctgattttgcccgaactccagcacttaatttttgaacgcagcaaccaaagaaaggatcttcaccaccatgctcactagacgaacccccatttccattgcccaagcccaagccaagatggccgccgtccccctgaaattaaccaccgaagaaattccggtcaccgaggctaaccaccggatcctggctaagccggcccaagcggcctatgactacccccacttccgtcgctcgggggtcgatgggtacgccatcttagcggaagacgaccacgactttccgcgcgactttgaggtggtggccgaagtgcccgccggggcagtctttgacaagcaacttcaaccgggccaaactgtccggatcatgaccggggcctgcgttcccgacgaagccagcaaggtgattatgatcgaaaagacccgtgataagggtgacgaccaagttaccatgatggcgaccgaaaagcacagcaacatcaccgaagtggggaccgactttgcgaagggccaagaagtaatggcggctccccaagaaattaacccgggtggaattgccgtcctcaccgcctttggtatccaaacggtgaccgtctacaagcagccacggatcgccatcatcgccaccgggactgaactgctggcccccaacgccccgattgaaaaaggaaagatttacaactccaacgggccaatgctcaagcgcctggtcgaagaaaccggtggggtcgttgacgaagaggttcaattacccgacgacgatgaccaaattcaagtggcccttgaagaagcgatcgctagccacgaaatcgtgatcaccgacggcggggtctcggtcggtgactacgacttcattggcgacgccgctcgcaatgccgatgaaatgctctttaacaaggtcaagcaacgccccggtagcgtcacgaccgccttcgttcaagatggcaccctggtgatggccctctccggcaacccgggcgcttgcttcaccggcttttacctctacatggaaccgctgattcgccgctaccaaggaatggacagccgggtcaaaaaggttactgggatcttaaacgccccttacaccaagaccaacggctttgaccggatcctgcgttcgacctacgaacaaaaagacggcacctactacgtctacccgaacggaaccgaccgctccggatccttggccaacctgcaaaccaccacttgcttctgcacgatcccgcactcaacggaaccaatcgctttacacagtgaggttgaaacatggctcttaccattcaagtagtcggccacaaaaagaccggtaagaccttggtcaccgccggcttaattaagcgtctgaccagggccggtttatccgttgcggccatcaagcacgacgcccacgacggcaacattgaccaacccggcaccgacagcgatcgcttttaccaagccggggccaaccaggtggtcttccagtcacgccaagggagttttcaacgctcccgcactccccagccactcgccaacctcgtggaccagttccagcaaacggccgacgtagtggtaattgaaggccataaagccgcgcattaccccaagttgattttactggcgccgggggaaagccgaagcgattgggcgggttttaacgccttagcctttggcgccttagctcaacaagccggcgtcgatttaattggggccccaaccatcaccgactggctctttaactacgtcattacccattaccaaaaagaggaaactcagatgtctgatccattaacccacttcaacgaccaaaaccgggccaagatggtcgacgtcaccgctaaacaagtgaccgcccgcaccgccacggccaccggcacgattcggatgcaacccgccaccctcgaccggattcacgccgggacgatgaaaaaaggggacgtactcgccgtggcccaagtggccgggatcatggccgctaagcaaaccagcgatctaatcccgatgtgtcacctgatccccttaaccggagtcgatatccactttacagacaacaaccaagacacgattacggccacggctaccgtcaaaaccaagcatgttaccggagtcgaaattgaggccctcttggccgttcagaccaccctattgacgatctacgacatgtgtaaggcgatcgaccgcgggatggtcatcgacaacgttcacctggtcgaaaaagacggcggtaagtcggggcacttccaatttagggaagccccggagagccaagcatgatcggcctggtcttagccggtggtcaatcgcgtcgcttcggggttgacaaggcgacctacgccttgcccggtcaccccgccaacgtggtgagtgccgtcaaacgacttttgcccctgtgtgagcaagtaatcgtggtggccaaccccgccaaccagaggcagatccaagacttggtgggtgaccaggccaccgtaattttggacccggaaccgtttcttggtgaagggccagtggccgggatcctggccgcctgccaaagcggggccaaggagcttttgctctccccctgcgactacccaaacctgaccacccaatcaatgcgggtgttagccgggcaaccaatgcgctatttacaagtagccggcaagaaccactacaccctggcccactttcaaaccgatcaagaaacggtgcaagcttggttatctggcggtcagcggcgcttgcaagacttcttaaaaggggcgttacactgtcaaccactggtaattaatgccgatcccaaagaatttactaactataaccaaaggagttccgtataatgaaaactatgcaagaaatggcgcctgccgatttccaaaagctgattgccctagtcttagccgacttaaccattcggcggaccttgttagaaaaccgggaacaagaagtgaaccaggaaatgcggtccctagaaaaggacgccgaactagaggacctagataaccaaattcaagccatccaggccgactatcaccactaccgggactttgttgatcccaactttaaaattgacctagatcaatactaccggggaatgaaataaataatattattcttttttggaatatttgcatattctaaacctcggggtataatatggaggaaagattatgaccgcaggacaaccgcaaccactgcaaacataccaggagttagttaaccgcttgtaccaacaaagtaactatgactttgttggcgtagcgctgcaagctcccgttagtccccacctcacccggtggctatgtgtggcgggcaaccaaaacgaacggttccggcgaattgttttgcgacgcgggattgggattgccggcctcgtattacgaactggcgccaccttttggcacaacgatattttagcccttgatctgagcgaccgcctctattcccccattgcccgagctgaaaaccttcaagccgtcgtggcggtcccgattaatgacgggccgttgcacacggttagtggggtcctactcgcggggtaccgtagcggccaccaccgggtttgtgaggccgatgccgacaagttgtctcaatccctggcctaacccaaggacggaggcgacttttttgttggaaacagcaaactggatccaaaccttttttgacttatcatcggacgcaaccttcattttccaggccaatcaactggtagtcgctaaccaggccggccaagacttgatcgacgcctttgacctggacctcgactacttacaagaactcgcccacaccgctattgctcagcaacagtcaaaggcggacgggtgctataattgtgaaattatgaaccagctccccgaattgaccgtgaccgttgacctaccaccggatcacactaatccgttgcgctacaccatggtttaccgggttctctcccccacggaccaggtctacgctctggaattaaagagccgggcaaccctcgaccgggcgacccaagtcgctcaacagcggatgttgaaccaatacgtcaaccgggcctatgaagatgagcgtaaacgaatttcccaggacctccacgacagcattgcccagggagtttattcggcgattatgggggtgcgtcgtttaaaaagcgagcaacttgatgaacccgaacgccaacaggttagcaccatgatcgagacccaacttgacgacaccctacgtgaagttaaagaaatggccctagacatccggccgtccgttctggactcctttggcttggtagcggctatccgtgccttagccaagcgcttgaccgagaactcgggggtcatcatcgacgtaatcggcaaggctgacaccagtggcctgactaccgacgtccaaagtgtcctctaccggatcactcaagaggcgatcaataacgccctcaagcacgctaacccaaccgaaattacggtcatgctcgtctcccacgcccactatatcagcttggaagtgattgataacggctgtggctttgattttcaagcccaccgtggctttaacggtcactccctgggcctaatgaacatgagcgaacgggtcaaggctttaaacgggtcctttatgattgactcggcacccggccaggggacaacggtgaccgtcaagttcccggtcattgaaatcaaccaccaagtaaacggggaatcgtagtatgtacaatgtattaatcgctgatgaccacgccatcgtgcgctctggcatcgcctacctaatcgataagcaaccaactttccaagtggttggccaaaccgctaacgggaccgacacctacatgcgggttgaacaaggcgacatcgacatcttgatcatggacctctccatgccgccgggtgaaagcggcctgatcaccgcccaacggattcacgaacactaccccctggtccggatgatcatcctctcgatgcacgaggaacaagagtacattaacaaggccattcataacggcgccatgtcatacgttttaaagagctcgccggattccgaaatcttgcgcgccctaacccaggtctctaacggggaaaactacattgatgaaaacatcaccctgaccaaaaaggacctttcccaaattaattccgatggtgttgacgtcaatttgaccggttataattccctttccaaacgtgaacgagaggtcttcccgttagtggcgctgggctacaccaataaagagattgccgctaagctcttcatttccaccaagaccgttgaggcccacaaggccaatatcgtccgtaagcttaagctcgaaacccgagctgacctggttcgctacgccattcaccaccacctaattgatatctaggctagtcaaggggctaggagaaagtaggttttctccccgtcccttttaattttccgttttttaggcaagcccccaatggtttttggactaactactgcctaaaattagcataaagaaccttattcgggaggaatttattatggccactaatttatcaagagatgatgaactgcggggaatcttaagtgacattacccgtcaccgtttcccatcacggcgccaactcaacccccagtccaacctctttttaaccgctaagtacgccgttgaggagggctacgtcacccacgccactttagacgaaagtgaaagccaatccctagccaccctcgacctaaccgaggccaccttaacggccgccggggtcgataagctggcggaactcaaccaactggaccaataggaggaacccatggacgcccaagaacagctcaaccgtaaatacaccaactcatcgatttacacctcggccttttacgccgaccccgatgacgccttagacaaccgcgccaaactctttgaggggctcaagtcctttaccatgaaccaacacgaggactcgcccttttgcttgcaagtgatgtcgaccaacagcgaaatcaacgtcatgcccctggggttgttggacctagaagaactcaagaattacgaacaagaacaacgccgggccaaggggctctttcaggccggtgacgaaatccccctggtggtcaaatacatcccccacgttaaagacgaagaggttaagcaaacggtcgtcaccactacccaagagctcttcgccgactttaacaccgccttcccaaaggtctgggcggccgttaacgattacttgcgggataaccaagccctgctaaacgccattgaagcggacctggtcgccgactttgccgacgtttaccgggagtaccaagctaactttacccagatgagtgccagtgaacgacaaaaggcgcttggttttgaactcaaggacgaagaacttgatcactttgcccgctttatggccgacatgcacgaggtccaagcagtgatcttctcggcggccggtttcgttaaaaaggagttagttggcgaaaataccttccaagaagtcatgaacgacaatatccgccgttccaccttcttttgggttctcgataacaccttttacgaggtcctttactacttcttgactcactacggccaggaaaacgccaagttggctaagcacctacgccaccaaaaggcgaccctcatttccaacatgcgcaacgacgccttcgaacgggcccaaaaagagctcagcgccgttgatgcaaccaccgattttgaaaagtacttcaccgacgtttacatcccggtcgccgaacaactggccgccgaggtggacaagtttaacgggggcaccaaatgaaatttccgcaccacgaagagctaaccgaggggttgggaaccctagttggccaactaccgccgctgattaaagagttgctcgacccaagtgtcgacgccaccgaccgcgacttacgcctgcacctcttcgcccttttaacaaccggtcgggagctgacaatggaccaggtccaagccgcttgcttacccgaatttttggccctcgggatgagtatgaatcccgcctcctttaacccaagccaaaccacccccggtgacttggcccagcaaaaggcgcggacctacctcttcccctacctgatgaatcgctacctagcgggattgcgtttgattaatacccccgccgccctgctaagtgagtttgaagtcgacgccggggacctagcaatcgcccaacttcaacggttacagtacaactacaacgcccacttcaaggttgccaactacctagccgatctgaaggcgcggactgggctactagcttccttaactgcccgccacgccatgaccagcgttactaaatcagcagaggtcatcggcttagcggggcaaattggtcagtccttagcggtggccgcccacatcattgatgagtgtgatcagttgactacccctacttacttcacagagcggattgtgaccgggacctacccgctagccctcttgttcacccgggaaagggaagccacgtggctcgatcagttcttcgcccaaccccaccggcccagcgaagcagacttcgcccgggccgctcagctaacaattgacaacggacgtggtcccgccctggagatggccggcgaattactcagccaaacccagctcgacgtccaagtcttaccagtgggtccggctaaggatgggctcagtcagttcattacccaagtgaccaatgatataaaatcggaatattagataattggggatttggaataaaaatatgctgattttgcggtaaaaactcgttataataaacttagtgataatgctaactttttgacgggaggtcttaaccatgaatcactgctgcgcactttgtcaccaccgctgcccccactcaaagtttcgctttggcttcctcattaatcgagggtgcctttgtgattactgtgcccagcaggccttcgccgcttccgaaaaagacatccgctcctggatgaaagagcacaccctcgaagaatttttgatcctccaccaagtcaatggtgacggagtccaggtttattaccacccggtttacgcccactaaaagtacccttttaacgggcaatcattttaaacgacaaagagcctgagagaaaaccgtgttttctcccaggctcttcctatatttccgaatgttagagcaaaaacgcgggaatcaccgcaagtctagtggctaagcaggccgaagaacggtgcggatcgcaccaaccgttcgtcctagcttagtcgtacgacccgtcaagaaggttcttccccgctcagttaacgcttcttttgaccaatgtgaatagcaccggccccgaagttgagtttagtgaccgtgacagaactcattcctgcttcttccatcatttgtttgagcttctcagccgaaacaaaggcccgggaagtctgctgaaggtaacggtagtctcggtagttgcccccaaaggccttggccatcagtgggaacagcttgaagtagcccttccaaccgacccggacgagcgggttattgggttgtgacatttccaaacagccaaagacgccacccggtttgagcacccgagtaacctcggccaatacctgattggcgtctggaacgttgcgaaggccaaagccgatcgtgaccacatcaaaggaattatcggcaaaggggaggtgcatggcgtcggcctgaaccagttcaatgtctttttggaggtccaggtcgcgcaccttcttttccgccaggtccaacatcgcttgattaaaatctaggccgattacgcgccccgtccgaccggcccgcttagctaattcgatcgtcagatctccggttccacagcacaggtcaagacaatcggccccaccagcaacgtcaagctgggtgaaaaaaaccctgcgccaggcccgctgggttcccaagctgataacgttattcattaaatcatacttcccggccacccgggagaataattgattgacctcttcttcagggtgctgattagtgagtggcatagtaaatcctttccgtgtaaatcacatcatacgctaatgaggctgggaaaaatcttgtttttcccagcctcttactatctttgtttggttagttggctaacaccttacggtagtttttctttagggcagccacttgaacctgaaccacgttgttccggttcaggcgggcaaaggccagtgcatcattcaagaggttcgcgatctcttgggggtcgcccccttggtctagggcgttttgagcctctaacacctttagccgtggcaagaagtacgtaacgtgcttacgtgcgcagatgctaaccccttggtgaatcaagtggttactttccttgatcttaccaatcagggcttgatattcagctaggtagtaggtaatcgccagtacccgtaagtcatcttcgtggggaccagtatcttccatttggttcactagggtctttaagtagttggtgaccttagtgaagaagaaactggcccgttccattgagtcgtgacgggtgtagtaaatccccaacccgaggtaagccaagtacgaataaatcgtttggtggcgttcgtccagttcatcgagaatctgggtgaaggagaataggatctcgctactctcctggttagttaaaacgtagttaaagccctccaagtagaagtaacgcatcttttctttgttagccatgatctgatcaatcttaagcttgttaagccccgctgacacctgagggaagttctcgatcattaacccctcctccacttggtccaaagtgtcgcggatgtagcgggcagaagaggcgtcttttctggtcaggtcatcgatcgttagccccagccggttacataaccgggttaagatcgctagcgacggtacctggctgtccttttcgaacttactcaaagtcgactgggtacagatccccttactaagggccacctgggaataaccaagctgtttacgccgtttgataaataattctacgtccatggtggccctcctttctagccgtgaatccccaaagcaatcttagcaaaccgactcatcttggacatgtcccaagccggctcccaaaccaggttaatgtcacattcagtaatcccgtccactgacttaacggccttgttaatttcgctgtttaacaggtcgccgagcgggcagcccatcgtcgtcagggtcatcgtaatcagacacttaccctcttcgtagacttgaacgtcataaattaaccctaggttgaccagatcaatcccgagttccgggtcaattacgttttctaaggcggccatcaccttgttttcgatcggtgaaaatggggcgccctcattttgatcagcagacatatgatccctccagattacttaacgatacgtgcatcaccgcgaatgaagtggtgccataatgcgaacagacaaattacaccggtcaagactaacaagccgatcccgagttcgtaagagcccgtccattccttgatccaaccgatgaccagtggtgggaaaaaaccaccaaggccccccattgcaccaacgaagcccgttacggccccggtgttaccctgggaaacgtacggaaccatcttaaagacaaccccgttaccaaccccagcagcaagcccaactaagacaatcccggcgataaagagtggttgcgacttaaagcttaccataattaggattgcaaaggcaataatggccacaaagacccattgcaaaagcatcatcggccgcatcttgtcggccatgaaaccaccgaccggacgaataatggtgcagaccccggcaaagagggcggcgtacaggccggccgtcacctgagagtaattaaacatcccggttaaaaagagcggcgtcaggttagtaaaggccacgaagagcccgaaggtgaggaagtagaacaaggataggtaccaagtggaactttccttggccactgacagggcctcactcatcgtcttgttcgggttagttggcatttccttacagaagatggcgaagatcaccccgatcacaacggtcaggatcatcaaaaaattgtaaacggcggtaaagccgtgggacttggaaatgtacggcagggtcagggccgccacggcgttccccatgttccccatcgaaacgatccccagtgctagcccctgttgttccttggggaaccaaactgaggcgtaggaaacccccacggcaaaggaagttccggccatcccgactaagagggccgcaaaaaggagcatcccaaaggagtgcacccgcggaatcatgaacagcgggattaagatgaagatcatcaagatgatgtaaaccttcttaccaccatacttatccgataagatccccaccggaatccgggcgatcgaccctaacagaaccggcgttgccaacagcaaggttctggaagccacactcaggtggaacatggtcccaacctgggcggctaagggggcaaagtttgaccaggacataaagcagacgatcatggccagggtggctaaaattaacgcagtataagcgttcaggcggctcccgtgagccacgtcttgttgtgtagttgccattatcattatcctccaatttgactcatgtgacgccaagttggcgccttatcaatgatccgatcggtggtcttcatggccatctcgtggttgagcggcttgttatcaagtgcccgctgtacgccggccttgaaggcatcaaaatcgtagatcagtttacgaacgttgatctcttcattccagtagaggcatgccttaatgtagccatcggcggtgatccgcaaacggttacaattctcgcaaaatttggaagaaatagggtgaattaagccaaagcttcccgtataaccctcaacttggtagttgtccgatggtccgttgcccgctaagtcaatcgggtggtaatccagccccgcttgcttacacaggtcaaaaacactatccagggcaacgtattcttgcttccagtcctctaaggaattaccaattggcataaattcgataaagcggacgttgacatcgtggtccttagtgtagttaatgaagtcaagcagctcatcatcgttttggccgcgaattaagacaatgttaagcttaatctttttaaagtgtagtgccgaagcggtcgcaatcccgtctaaaacctggttaatgtttcctccccgggtaatttccttatagacctccggtttgaaggtatccaaggaaatgtttaaccggtcaagccccgcttcctttaaggccttggccttctttgctaagaataggccgttcgtggtgatggaaacgtcttcaatcccgtcaatttccttaatgcgccgcacgatgtcaaccacgtccgtccgtaagaggggttcgcccccggtaatccgcaccttatgaacacccaactgggcaaaattagtaattaactgaacgatttcatcctgggataaaacccggtcggtgggaaaaaaggggagcccctcttttggcatgcagtagacacaacgcaggttgcaacggtcggtaatggaaatccgcacgtagtcgtgcaaacgttcatattggtcatataactttttcatggtctcctcctaaccgccactgaccggcggaatcaatgcaacttcacttgcttcactaagttgtaaaacatcctcgttgacgaattcttgatcaacggccacccggctattagccaaagtggcttctaaggctggatctagctctagtacggcatcttttaatgcggcttgcgtgactgatttaggtacatcaatctctaccgcaggaccaagacgctcccccaaaaaggcgaacagtttgacagttaccttcattattctccccacctcactttatcagtgtcgaattcttgcttccaaattgggacttcctgcttaagggtatcaattaggtattggcaccacttaaaggcgtcgccccggtgagcggctgccacaccgacaaagacggcttcttcggttaactgaagttcaccggttcggtgggcaatcaccacccgggcgccctgttgttcaattggttcagcaagtttttctaactgccgctcagccattgggtggtaggctgagtaaacaatccgttccgtttcgatctctccggtccattggcgaatggtcccgacaaacatatcgatgcccccgtatttggggtcaaccaatttagcgtagagttccgcaacgttaaggggttcgtctgaaatcctgagataatacattcgctatcaccttaccttatcagtttttattattacaatttgtttaagggtttagaattagttaaatccctaataaaccgggcttgcagacggttcccccgttactgttttcagtcctgtttaataattattccaattttagttagagattgggtgacccttgttgaccgtgtcagcggtcattgggctgccccacctgttacttacatgataaattcaatattccgattttgtctttaaggttattccctaataattgttttttttgctcaatgctatacttgatttaaatcaaaccagaagggggaatcacccacgttatcaatcgtctacgccaccatttccggtcataacttggaactagccgactacctgcaagaacaggtagcttcgtggccgcttgcagtcatgaccgccgacgctgccgttgctgagctccccaccggttcactctttttttgccccgctacgtatggtgcgggtgaactaatggacgacggtgacctctttttaaccgacctcactagtagccctttaaacggtcaaccattttgggtcgtgggaattggtgatcaatgttacggcgatgactttggcgccgccgtccttcacgccgaccaggttctaagggcggccggaggcaaccaactggctgcccccctgatcattgattatgaactcgatgaccttgccaaggacacacttaaaaagcccctcgcacaaataaaggagacccttcttgataaaccgtaagtcaacctatttaaccttaattatggccctgttgctactcgtaccactcaccttaatcgccctgtcaatcgggcgaatgcaactaagccttggccaaacttgggcgggtttaatcgaccccaaacataacgccttatacgccaatattttgtatgatatccggcttccccgagttctcggggcgatggtgatcggggcggccctagccagctctgggatcgcctttcaaaacctcttcaataaccccttggtttcccccgacttattaggagtttccaacggggcagcggttggtgccgccctagcaatcctcttaaacagcaacctctgggtggtgcaagggtttgccctaattggtggaattctggccgtttcaatcaccgtcttaattccccgcttagttggccaaggaggcaccctcattttggtcctctccgggatcattatctccgggttcatgcaagccgcccttggtctgttaaagtacttagccgatccagactcccaattgcaaagcattgtttactggcagttggggagcatcgctaaattagacattccgagcctgctggccgctttaccaatgatgatcattggttttatcatcctaattttcttccgttggcacctcaccatcatgtctttgggtggtcaaacggccgcctcgcagggaattaacattgaacgcgaacggttagtaatcatcttggcggccaccttgctgacggccggggcggtctgtttagccggaaccattggttggattggcctagtggttccccacattgcccggcgcctgattggggataacgctcgtttcgccctgccgcttgccgcgatcttcggtgccgccttcctgctagtcattgataccctagcccggaccatgtcggccggggaaattccgctttcgatcctgaccggtttcattggcacccccgtcttcatctacatcctcactcacagaaaggacctaattcaatgaccctcttaaacgtcaaccagctccactttgcctacggggaccggacgattttcgatcaggtcagctttgacttagaaccagggcaaattatgaccattctcggtccaaatggggtcggtaagtcaactttgctctcctgcctaaccaaccagctcaaggaagcaaacgggcaaatcaacattaatgaccggccgctcgacttttggacccccaaggacctggctcaacacatggccctagttccccaggactaccgatcgggggcccacctaaccgtgattgattacttaaccaccgcccgggccccttacctcgggctcggtcaggttcctaacggtaaggacgaacaactcgccattgacgtcttagaagacctgggtattaaacagctgctccaccgccgcttacccaccctgtccggggggcagatgcaactagtggcgattgcccgggccctggttcaggaaccggaacttttgatcctcgatgaaccaatggcggcgttggacttaggacgccaacgccaagttttaaagattgttcaacaactcgcaaaaaggggcgttgcaataattttaacaactcacattcccaaccaagcactactcttaaatgaccaggtcggcctcctcttcccaggggggaattccttgctggacattgtcaggagataattagcagcgatcgtctagaaaaactctatcattgcccagttaaggtggtttatgtcccagaattgggacgatcaatttgtgaaatgtgctaataagtcagttttgcttaaaaagaccgacttttcctgatataattggtactagaaagcggttttcaatttggaagaattggtgatcatgtgaaaatccccctatgtaaaacggggcttcacccaccgaccaccgttagtcgccaacgatggctaggccagtgatcgcttgccttccgatttgggtcaaccacgatcgtagactaaaccaactctttgaggggtgctgcaaagggcacccttaacgcatagagacgggaggaatcataatgaagaaagttgttgttttaggggccggctacgcaggtctgaaggtcgttcacgaattacaaaagcgcgccaaaggacaggtagaaatcaccctcgttgataagaacaactaccactacgaagcaactgcacttcacgaagttacagctggaaccttgccaccaagcaagatcagctacccggtagccgacatcatcaagccagccgtgaccaccttcatccaagacgaagtaaccggttttgacttggacgataagacggttagcttaaagaaccacgacgctttaagctacgactacttggtaattgccctgggctttgtttctgaaacctttggggtggaaggggccgaagaatacgccctgccgatggccaacctcgaacaagccgaagccatccacacccacatcttaaagatgatggatgaatacaagaagacccaggatccaaactacctcaagctgattgtttgtggggccggctttaccgggattgaattggccggtgccctcgccgacgggcgtaaggaatatgccgaccgtgctggggttaacccatcccaaattaagatcgaagtggtggaagcttccacccgcttgttaccaatgttctccgagaagttggctaactacggggttaacgttgttaagggactcggggtggaactggtcactggcgcccggatccaaaaggtagaaccggacaagattacctacacgatgggtaaggacgaagaagaaaccactggcaccacgaccgggaagacgatcatctggacgactggggtttccggtagcccaatcgtccaagccgatgaagccttgaaggcgcggcgtggtcgttccattccaactgaccacttaaccgttgaaggacacgacgatgcttacatcatcggtgacgtcgccgccgtgatgccaccagaaggcggacgcccatacccaaccacggcccaaattgcgctgggaatgggtaagtacgtggctgaagacctcgctaaccggatcaagaacggcagccaactggccaaaccattcgtatacaagtccttaggaacggttgcttccgttgggaacacccgggcctttggggaagcaatgggtcacgaataccgtggttacgtagcttctgccctcaagaagatgattgccaacgaatccctttaccgggtagggggcgctggtcaagtccttcgtaacgggcgatttgacctgtaccactagaaacaactttttaattaaccaaggggttaggagaaaaccgtgttttctcctaaccccttttatttatgaccattagctctaactaaagcaccagtatccaactacggttagtgaccgccgccctatctagtcaggcgggctgctggggcacttatttatcactccctttggctcccagattagggatttcccctaatatataaaaatggaatattagtgctagaatatagttaactaacttgtggaggatagattcatggaaaaagaagcattaaccagtcaggttctcgacgccttagaggacgtcattgacccggaactggggatcgacatcgtcaacctcggcctgatctatgacgtcgacgttgatgacgcgggcaactgccagatcaacatgaccctgaccacccccggctgtcccctttccgacgtcttggaccgcgacattaaagaacacgccggtgccgtcgaaggggttaaccaggtcacggttaacctagtctggtacccagtttggacgatggataagatgtctcgctacgctaagattgccctggggatcggagggatctaaggatgaaagtaatcgattttaacctgcccatcaaacagctggccgatcagtacgatgattttatcccgttgatggtcgaactgggctttaccaagatcaaaatccccggaatgctcgaatcggttggtcgcctggtgaacttaaataagggctgccgagcgatggggatcgacaaggacaaggtagtggcaacctttcgtgaccacggttttgaggtgatcaatcatgacaactagttccgtcgaacgccaaaaagcgatcgttgaaattctcaccttcctccatgagggtggtgactttgatcaagcaaaggaaatgtttgacgcccagtttgggagcgtcgacgtctccgaaattacttcggccgaacgccaactaattgctaacggccttaacccaatggagatccaaaacctttgtaacgtccacgccgccgttttcaaaggttcgatcaccaataacgccgagaccccggccttccaaaagcctggtcaccccgttaacacccttaagctggaaaacaagatcttgacctctttaatcaacgacgagttactgccggtcgaaaagaagtggcaacaagacggtgacaacccggcctatttaaagcggatgcaacaagcgctcgccgactttaaaacaattgataagcactacgcccgcaaggaaaatacgatctttcccctgatggataagtatggcatcaccgccccgccaaaggtcatgtggggagtcgatgataacatccgcggttggatcgaccacgcctaccagttggtgaccaccaagccgctaccggataagtacgaaatcgaagcggcgattgaaaaggtcgctaaagaggtcatggagatgatcttcaaggaagaagacatcatgttgccgatgctagacgaggtcgccaccccgaccgactggaagatggtcagagacgacgaagaagagattggctacaccctgatctccccaccgctaccgtggaaaccgaccgaagcggaactagaagaagcggccaacaagccggttaattcgacgattgctgccgaattgaacaaaatggccctgaacctggccgaccaagacgaccaggttaccgctgttaaggacgcccctactcaacacgaaaagttgtcccaaccagctagcagcgacgatggccacttttttgaccttggtagcggtagcctcaacttaaagcagttggtggcgatctttaaaaccttgccggtcgacctcaccttcgttgaccacaccgatcacgtccgctggttttccgacaacgccaaccggatcttcccgcggaccaattccgtcctcggccgggcggtggtcaactgtcacccgccaaagagcgttgataaggtagaaaagatcctcgccgattttcgctccggtaaggaggaccacgccgagttttggatcaacctgcacggcgagcgtttcatccacatcgaatattacgccttacacgatgatcaagggcaatacctcggttgcctagaggtcagccaagacctcaaccacgctcgttccttaaccggggaacggcgcctgtaattaattaccattgggagggatttactattaattctgtcactagccgccggcgaacctacttgggagtggagttgaacctgatttcactccttttttcttcgatttcaccggtcctcaataagttttcactggtcagcctcaacgccgtggtgggtggggttttaacctccacctttgcggccgccttcaacctaattttgatcatggtgacctacaaaaaggtctcgatcgtaaaggataaaatggtcatcattttaggggccactaacgcgatcggggtcctcttgcaatatattgccctgtcaatgctcagtccggtgacggtcaccctgatcgcccgcatttacctagtttacgtcttcttattaggcgggatcttcttaaaggaacggatccggggctgggattacgtcgccatcgccgcctgcatagccggctcaatcttggtttcctctgggcgggcgcaatttgattcctggctcggtattctctgcgcctttatctacccgttcatgtacgcggccaacaacgtgattgctaagtacctggttcaaaatgaccacccagccgacgtcctctttttcaaccacttggtctcggccctgctcttgttggtggcgggctttttgatcccccatacctacactagcgtcccgctaaccggggttgcctttaactttgggggcgcctttttcaacggtttcttgtcgctgttactcttttacactagccttaagtacatcacagccggtaaggcgaacattgtccgggccctggggccgctgatcgtgattgtgtattcctacttcttcttccccatcaccatcaacgcccagattatctgcggagcgctgctcttgattttggccaccacgatcgtgaccgtcaaacaagcccaggtaaatgaataaaccttactttccccgctgccttcttggtgacggggctttttgcatgacgaatttacaattgaagtgcaacaagtaagaagaaaataaaaaagaactcatagcctgagtcctgtaaaatgaagttaccacaacaaacatctaaaggagatcttaggctatgagttcgtacaaccatcttaccttaaaagaccgagaatgcatactattaggcgtcactttgaaggacacctatcaagttattgcgcagaggattgggtgttctaaagccaccgtatcgcgcgagatcaaacgcaatggcggtcgtaaggcttactcagccgtcaaggcccaagagaactatcagggacgtcgactaaaaagccgacgtcctaggcttctaactaacttgaagttacgggattttatccttcactgtattgttcaacgtcagtggtccccggaacagatttcaggtcgtttagcccacgaaaacagcgaatggcgtatcagttataacaccatttatcgtgggattgaacgcgataatttaggcatcaaacgtaagagtcacggggctcgtggctttgcccgtaagctccgtcaccgtggtaaaacccgaaaggccaagggaaccattaaggaacgtcgaggacgatttaacgacgtcccttccgttcatgaacgcccggtttcatgtgagaatcgaagccggtttggtcattgggaaggtgatacaattcgcggtaaaaccgggcgttcagccctggtaaccttagtggaccgtaaatctcggtatttattatctcagcgcgttctcaaagtaaacgccaagaacgtcacacaagcgatgattgacctcctgcataccgtaacgcctaaacgcgttcggacgcttacgccggaccgtggaactgaattcgcaggataccgtgaagttagccaagaactaagcattccagtctattttcccgatccccatgcgccccaacaacggggaaccaatgagaataccaacgggcttatccgtgagtatttccccaaaggaaccgacctagaccaactaactgatcaagatatcgacaagtttgtcagggatttaaatcaccgaccacgtaaggtcttaggctggaagagtccatttgaagttttcttcgggacaaagttgcgcttgatttgacaattcgtcatacaaaaaagcccccgggaagggagcaaaatgtttggtgtggtaatttaagcttacttcggcatttccccggtgaggatttgcttagcttgcttcgtggttaagtcgtagttgtagtaagtcttgtagaaggacttggtcttcttaaccatgtccaggttcttgaattggtctgggtgaagcttttgggcggcccagaggatttgcagcgcttcttcagcactgtaacggtcccacggaaaggtcccttgtgggttaccgtaaaccttgttatccttgacagccttcaattgggaaagggtggaatcagccttcaagagcttacgagcgttggcggtcgtggtttgaccaacgatgatcacgtctgggttagccttcacgatgtcttcggcattaacggtgatcatgttaccggcagtagtgatggcgttcttaccgccggccatcttaatccattcgtcaacgatcgtcttggtcccatcaaccttagtcaggtcagctgggctcgtgatgtgcaaaacggaaggagtagtcttaacacccttaagttgctttttaacgtaggagatgttgccgtcgaggtacttgatgtacttcttagcgatcttcggggcgtccccacctaggatgtcggccgtcaaagtgatcgacttcttcatcccggcgaagtcttggaacatggcgttcacggcggttaagttagcctgcttagcctgcttaacttgttccgggttggatgaaatcacaacgtccggcttcgtcttaaccagagattcgatttgaatgtcttgaccggagaacggcgccgttaccttagagattcctgggtcaacggttttaaaccagccctcttgcttgatcattggcgtggtggcaaccaacttcttttggccaccaagcaacaagaccacttggttgctggcgtgccagaggttagccacccgtgttaccttgggtggaaccttcaccttggtcccggtcatgtcggtaaccgtcttggtcttagctgcggcactaacggtagttggagcggtaatcccggtaaccggtgcaacgaccccggtcagtaaggtcccggccagtaccaggcccgcaaaacgcttccacttgaacttcattgatttttcctcctcaatggctattccaataaattattcttttattaaatagccatattcaaacattgttcataaaaaattatgacccccacaaaaggttttgtgggggtcttggttgcgatttcaggcaaaattagggttttccctaactttaaaaattattaaccgattgacccttccatttcaaaggaaattaggcggtttaactcaacggcgtactccatcggcaactgcttggtgaatggttccacaaagcccatgatgatcatttcagtggccttttcttcggaaattccgcggctcattaggtagtagagctgctcttctgaaatcttggaaaccttggcttcatgctccatcgccacgtttgagcagttgatttcgttgtaaggaatcgtatcggacttggattggtcgtccataatgatcgtatcgcattcgacgtgggccttggagccttcagcgttcttggtgaagcgaacggtcccccggtagtcagtcgagcccccggtccgggcgatcgacttagaaacgatcgaactggaggtgttcttggcgttgtggatcatccgggcccccgaatcttggtggatcccgttagaggccacggcgatcgacaacatcgtccccttggccccctcaccatctaagtaaacggacgggtacttcatcgttaccttggagcctaggttcccgtcgacccattccatggtcgcgtggtccatcgccgccgcccgcttggtttccagcgagtagacgttatccgaccagttctggatcgtcgtgtagcggcaataggcgtcctttaagacgttcacttccaccacggcggcgtgcagggagtccgatgagtagttcggggcggtacacccttccacgtaatcgactgaggccccttcgtcgacgatgatcaaggtccgctcgaactggccggtattctcggagtttaaccggaagtaagactgaatcggcgttttagtttgaacgcccttgggcacgtaaataaaggagccccccgaccaaacggcggcattaagggcggcaaacttattgtcatctggttgaaccaacttgccaaaccactctttaaacaggtccgggtactcgcgtagggcggtatcggtgtcggtaaagataatgccgagcttttcgaattcctcgcgcatgttgtggtaaaccacttcggattcgtactgggccgatgagccggcgaggtacttacgttcagcctctggtacccctagccggtcaaaggtcttctttaagtcgtccggaacctcttcccagtcgcggaacttcttgtcggtcatcttttggtagtagagcatgtggtcaagatctagttctgatagatccgggccaaacttgggcatcggcatcgctttgtaaatttcgtacgccttaagccggtaatcgagcatccactcgggttcatttttttccttggaaatggcgcgcacgacctcctcggttaacccccggcccgttgagaagaccgggtggatgtcgtcgtggaaaccatattcgtattcctggtcgtcatgcaggatttcgctagccttggtcatcaatatcctcctcatcagtgtcctttaacagtgcccgctgtaaggcccaccaagctagggtggcacacttgatgcgggcggggaattccatgatgctggttagcacctgggcgtcccctaacgcttgtaggtccgctaggtcatggtccttaccgatcgccatgtccgaaaagatcttagccattgccagagcctcgtctgggcgcttccccttgacggcttcggtcatcatcgacgccgatgcctgtgaaatcgtgcagccgtgaccggtatagccaatttcgtcaattaagccatctgaacctaccttgacttgcaagtcgatttcgtcaccacaagtcgggttatttaaggtaatggcgttagtggcgtcctttaaggctcccttgttgtgggggtgatcagcgtggtctaagataacctcccggtataaattatttaacttagatagtcccaattctgaagaactcctttgcttcctttagtgctgacaccaacttctcagcgtcagccgcggtgttatacaggtaaaagctggcccgggcgctggcctccagaccaaggtaattcatcaatggttgtgcgcagtggtgacccgcccgcacggcgaccccttccatgtctagcgccgtcgccaggtcgtgggggtgcaggtggccgaggttaaaggagatcaccccggtgtgattagccgggtcggtcggtccgtaaaccgttagcccctcaattgcgagtaattgaggcaagaccgtttgcaccagcgaccgttcgtgggcttcaacctggtccattccaatcgccgtcaagtaatcgatcgccgcccctaagccaacggccccggcgatattttgggtcccggcctcaaacttgtacggcagggccgcccaggtacttgcctgttcggttaccgtgccaatcatttcgccgccgtactgataagggggtatggcctccaacagggcttgtttgccatacaagaccccgattccggtaggcgacatcatcttatggccggaaaaagcgtaaaagtccacgtccaattcggttacgtcaaccttcatgtggggaaccgcttgggccccgtcgccgacgataatcgccccgtgttggtgggccaacttggccaattgttttaagggcgtcaccgttcccatcacgttggaagcgtgagtaacggcgacgatcttggtacggtcggtaatcttagccgcagcatctgccagatccaattcgccctccttcgttaaaccgatgtacttaagggtagcgccctttttaagcgctagctgttgccacggaatcaaattggagtggtgttccataattgagatgacaatttcatcgccggcctggatgttttgctcgccgtaagtggcggcaaccaggtttaaggaatcggtgcaccccttggtaaagatcacttcttctcgcttctttgcgtgaatgaacttctgcaccctatcgcgggccgcttcgtaatcggcggttgcccgttccgctagggtgtggaccccgcggtgcacgttggcgttatcggtttggtaaaagtcgagtacctgcttaagaaccggggtggggcgctgggccgtagcggcgttatcgaggtacaccagaggctcatcgttaacctgctggtccaaaatcggaaagtcggcgcgaaggtcactaatacttttgtccatctgcaagcttcctttctagtaccgctaccagcttatcgcgaacgtttttggccgggatggcggttaacacggagcccaggaagccccgaatgaccatccgctcggcggtcgcccggtcaatcccgcggctcattaggtaatacatttgttccggatcgactggtccgaccgaagcggcgtgaccagcgaccacatcgttttcgtcaatcaaaaggatcgggttggcgtcgccatgggcatctccggacatcatcaggacccggttttgctggtcggccttggccccgtgcgccccgtgaacgatttgaccaatcccgttaaagatcaactcggacttttcaagtaggaccccgcgctggttaatcaacccggtcgtcttcttgccgcggttagtaacccggttgttgacggccatcaactggctgccggtggtcacggcgatcgccttagcgtcggcatagcccccctggccaatcaattcggagtccatgtcccccagggtgttgccgtcgttcattaagccaaccgcccattcgacgtgagcatcgcggccaatgttggcccgccgcttgaagtaaacgtgggtgttaggccccaattcatccagcgaggagaaggcgacgttgctcccctcttgagcgacgatttcgaccatcatgttagccggcaccgaccgttccccgaccgtttgtaagtgctggaggaagtggatcttggactgggcctcggcgacaatcaagaggtgggagtttaacggttggtccttggtggcgtcttgaatgatctcggcttcgatcggggtgtcaatttcgacccccttgggaacgtataagaagaccccggcgtttaaaaaggctaagtgtgcggcggtcatcttattttcccccggcttaaccacccggttcataaggaagcgctcaatcaagcggggatgaatccgggccgccgagaaaatatcggttaagataaccccttgttggcgcagttcttccggcagctgaacctcggtggtagtttgaccgacttggacaatccggatcacatccgggtcggagtcaagcaacccctcggccaggtgcgggtcggaatcctcaaaggccagtggttggtcacttaacagtggccaatcctcaaagtggtaacgcgggatcgttggcatcttttggtcggccatcagttgcaaagcttccaggcgccgatccaataaggtgtagggctccccgtgttggtgggaaacttcctctatttggtcggcgatcgtttgaacatctaatgtcatcgtcgtcctccttagtggttgtcatcaacgagcttgacgtcgaggcccagttcgtcacgcaagccagcgtacccttctgcttccagtttcttggccaattcggcgtcaccggtcttgacgatcttgccgcccatcatgacgtgaacggtgtctggcacgatgtagttcaagagccgttggtagtgggtgatgatcaaagaaccaaagttatcaccgcgcatcgagttgacccccttggagaccacctttaaggcgtcgatatccagaccggagtcgatttcgtcgaggatggcaaaggacggttcgatcatcaataattgtaaaatttcgttacgcttcttttcccccccggagaagccttcgttgaggtaacgttcggtcatggattcatccatgtccaagagggcgaggttgtggtccagttttttgataaagtccatcactgagatttggtcgtcggcggggcggcgggcgttgatggccgcccgcaggaattcggcgttagtcaccccttgaatttcagccgggtattgcatggctaagaatagccccttgcgcgcccgttcatcaactggcatctcgagaatgttttcgccgtttaagaggatttcaccttccgtgactgtgtaaccgggttgacccatgatcgtttgggaaagggtcgacttcccggtcccgttcggccccatgatggcgtgaatttcgccagtcttcatcgacaggttaactccctttaggatctccttggtttgctttgtctcgtcatcggtcaccgaaacgtgtaggttcttaacttctaatgttgccatgtcaattcctccaaatcaggcctattattccaattttatataaagaatctaactgggggcccgtttattaatcacttgtcttatattatagtcgttacaaggtaaaataaaactaggaaattccccgatatctgtttctggaatcttgtataataatatcactaactaatataatgaaaatatcaggcaatttattatatatttttggaataatattacaaggaggggtttttgatgccggctaaatataccctgacccactttgagctgctcaacgaagccacccaagagcggctccacaaccttggtttatacgaaggaaaggacgtggcgttgatccaacgctatccattccacgggccagtcatcatcgaaagtgatcgccagcgaatcggcctacgttaccgggtcttttgtcaactaacgggagggatggagtcatgaccaccgttgcactcttgggtaaccccaacaccggaaaaacaaccatctttaactccctaaccgataagtacgcctacgtcgggaactggaccggggtcacggtcgaaaaaaagcttggccaaattaaggacagcgccgtgaccttagtcgacttaccgggggtctactccttaaaccccttaactaaggatgaagcgatcgtcacttcttacctattaaacgaccaccccgacctgatcttaaacgtcaccaacgccggccaactgaagcgcaaccttttgttgaccattgaggtcttagaactcggggcgccggtgattttaaacctcaacatgatcgacgacttaaagcgccagggcaagtactatgaccccaaggtcctcgaagaatggctgggctgtgaggtgaagaccaccaacgcccgttcccacgagggggtcgccgccctcaaggccgaactggccagcttaaaggagcgccgccaggccaaaccactgctcctcgactacccgccgatggttaagcaggcaatccgtcaggccaccgaggccctcgtcaaagattacgatatggaccacgattacgcccagtggctttcgattcaatacatcaacaaaaacaaggcggtccgccgcttcgccctctttagggacttgaccccgctgcgtagccaggaaaaatactacgacgcccaaaacttcgaagaccagattttcaatacccgctttgccttcatcgaaaagttgctgggggcggccagccaacccatcgcctcgaccagcaaagtggaaatgacctctaagattgaccggatcgtgaccaaccccgttttagggttgccaatttttgccgggatcttctttttgatcttcaaactgtcctttgactgggtgggaacgcccctgtctgacatgctagacggcttcatctccggccccctttcgaccaccgctaaccaggtcctgaccgcagccggggccttaccagtgttacggtccttgattgtggacggcctgatcgccggggtcggggggatcttggtctttatcccccaaattttcgtcctctttgcctgcatctcgctgctagaagattcgggttacatggcccgggcagccctggtgactgaccggatcatgcagtttatcggattaaacgggaagtcctttattcccttgatcattggctttgggtgtaacgtgaccgggatcatggcggcgcgaacaattgagcaaccaaaggaacggttaatcacaaccttaatttcaccattcatgtcctgttcggcccgcctgccggtttactcactggtggtcgccgccttcttcccgaagcaccaagcactgattgtcctatcagtttacttcctggggattatcgtcgccctcttagtcgctaagggttaccaactctactttggcgtcaccgactcctcggtcttcatcgttgaactacctcagtaccacctcccccgctttgacgtcatttggcacgggacttgggacaaggggaagggcttcgtgaaaaaagccgggacggtcatctttgccgggacggtcatcatttggctattggcctcctttggcccccacggtttcgtcactaattctagccactcctttgccgctagccttggccacctgttggttcccttccttgcaccggtcggtatcacccggtggcaaacgatcgccgccctctttaccggggtcttagctaaagaagcgatcacttccagtatgatggtgatgtttcacaccagcagccaagcggtcttgattagcgccctgggccaattcatcaacccggttgccgcttacgccctcttggtatttatcctcttgtacgccccgtgttttgccaccttggggacgatcaagcaagaaaccggctcgaccaagtggacaatctggtccttggtttctagcctgatcattgcttacggcctggcctggctgatttacacggtcggcagcctcttcatttagaaaggagtttcccatgcttagtttaattaccaacaccgtcatcattttgctaatcatcggctgcgccttttggcaactcgttaaggtctttaagcgggccaagaagggcaagtgtgccgcttgcgattacgattgcgccgttaaacaacaggtcttaaaacaagaaaagcacggtgcccaataaaaaaaaagcgggcgacgggaaaattttcctgtcgctcgcttttcgttaatgttatgttaattggtgttaaatcaaccccaccgcaaaggtcacgacctggacaagggaaccgattagtaaaatccggatcgccgccggaaaggtttcttttttgacctgcttgttaaataaaagcttggtttgcttgacgacaaacgggataattaaaagggtcaacaggaccgtccacggcgttaagcgtaacactgccgccgcaataatggctaaaaaggcaatggtgtttttaaccgcaaaggcgtacagcgcccacttcttaccgataaagtggacaatcgtgtggcggtggttatcgttatcctcttgttcgtcgcaaatgttatttgctagcaacaggttggagatccatagttcatcaggcagcgccactaagaaaataacccccaggttagtccaagaccaggtaaagtccgctccggtgttcacaaaaaccgaaatcagggtgatcataaagcccatcgtgaacccggagaagaattcaccaaccggcagccccgataatggaaagggacccgatgagtacaaaaagccgaccgcaaagcaaaacaccccgagccaaagcaaggtcagccctagttgggtcaccaggtagattcccagcaaagcggcgataaccactagggtgatcaacatcgccaacactaagtgcggagataagttttcgcgcccgatgatgttggtgttttgctgatagtcctcggtgtcgacggcgtgaacgtaatcgtggtagttgtccaacatatcgaccgccatgttaaacaagaacatagcgataaaaaagaggagcgccagcattggttgcacggtgtggtagtgataggccgctaaaaagaggccgagtatgaagggcaagacactggcggtcttggccttgatttcaaccaattctaaaaatactttgacagacattaaataagtccaccctttcccttatttattcaattccctatttagggtacaatagacagtataaaccttaaaggaaatttaatgatgaaacaaacacattttccgcacaaccccgaattaaatcgggccctcttagccgttagcgacctaatggcagcccggatcaaaactaaggatggccaactagaaagcgccctgcaaaaaatggccactaacggcggtaagtttttgcgccccgcctttttctggctctttgcttccctgaccggccaaccgcagccagaacaacgcgaccgcttaatcaagctggccacctcgattgaagtcctccacatggccactttaatccacgatgacattattgacgactcccccgagcggcggggacgcatcagcattcaagccgagtttggcaaggacgtggcggtttattccggcgattacctgttcacgatcttctttgacctgatcaccaccaccaccgctacaactccctttttgaccaccaacgcccagatcatgcaccggatcttaagcggtgaactgggccaaatggccgaccgtttcaaacaagaccaaaccttcctttcctacctgcgcaacatcaacggtaagacggccgccctcttctccttggcagctagcgaaggggcctactttggcggtgccgaccaacggaccgtcgccctagccaagcggatcggccaaaacgtcgggatcgcctttcagatcttagacgatatcctcgactactccagcggcgaccaactcaacaagccggtcctagaagacctggccacgggggtctactcactccccttgctgttagcgatacaagctaactcggccgcctttaagcccctcttggacaagggacggttaatgagtgaagcggatatgcagctcgtccgtcaattagtgcttgaaaacggcggggtcgagcaagcccgtcaactagccaccgccttcaccaagaaagccgaagtagaaatcaaccagctccccgccggttcctcccggcgtgccttaaccaagctgtgccaacgcctgttaaaacggagctcataactaaaacacccccacttaccaactgcaagtgggggtgtttttaattaaccgggtagagtggtcgcttaccgttgacaatccgaaccacgtcatcgagtcccatttcaacgatgtttttgattgcggtatcggtgaaaaaggctgagtgcggtgaaatcaagacgttgggcatcgcccgcaaggtcagataggattctgatacttcttctctgctggcttggcgttcaaagtagcccgtttcgtcggcgagggtgtcgagggccgccccggccagttggtggttttgcaaggcctcgatcagggccgccgtatcgaccaacccgccccgggccatgttaatcaggtaggcgctatccttcatcttggcaaaggctgttcgatccaggaggtttgccgtttcctcattaaggggggtgtggatggttacaatgtcagcttcccgaagcaatgtctcgaggtcgacgtaagtcaagtcggcctctagttccgcatggtgaaccgggtcggtggccaagacattggcccccagggcgctgtacaggcgggcggtggcaccgccaatgtggccggcaccaattacccccacggtcaggttgtagatctcagttgactccagccccacccaacgaaagtcgtaattatccattcgctggtcgtagtaaccaagtttccggactaggcgcagggcctgggtgagccccatttcggcaatcgcccgcggcgagtaggccgggacgttggtcaccagtaagtggtggtcggctgcttgctttaaatcaatcatatcaaacccaaccatccgggcggtcagctgcttgatccctaacccctctagagtcgcgtagacctccggatccaggtcattggtctgctgaaaatcgatcccgtcaaagcccgcggcccacttagcggtctccttatttaacccctcttcgaccatcttaacttggtggcctgttttgtttacccaggcctccacgtaggggcgttcggtgtctaagatcgaatacatcaaaatcttcattttaatcctccttttgggggtcaaagctttgccacttagcaaccgcttctttaagggtcgccattggctgagtggcggcaacacggacaaagccatcgccacccttgccaaaggccaagcctggcaccactaaaatcccggtttggttcaagagccgggtagcgtattgctccgaactaagcccggtcttacgaatgtctaaaaaggcgtagatcgacccgccaaccggattcacggcgtggttcggcaaggcgcccagggccgtttgtaaataggttagccgctcttggaaggccgccaccagcggggcaaccagttcatcgtggtgttcaagggcatagagggccgcatcttggctgatcgtgggcgccgtgtaggccacgttttcgttgaccgccgccgtagcatcggctaaatactttggccccactaaccaccccagccgccagccggtcatggcaaaggacttggacatcccgctaatcgtgaccgtattatccggggcctccttagccaatgggtagtagtggtgacccggcatttggaagtcggcgtagatttcatcggtcaagaggatcaggttgtggtcaattgccaactgacccaggccctgggcagcttcttgatcaagcaccgccccggtcgggttattcggcgagttgacgatgatcgccttagttttatctgtaagcgccgcttcgagtttggccgggtcaatggcaaagcccgcctcggggtccatggccaccatcaccggaaccccaccggccagtttcacctgggcggcgtagggagaaaagcacggctcggcaatcaagacctcgtcacccggatcgagtaaggcgtatagggccaacaagagggcgtgttccgcacccaccgtcaccatcacctgggcggctttggcgggtacccctagtttttgatagtattccgcaattgcttctcgcagctccggcatccccatcgccgccgtgtagtgggtgtgcccttttttggcgcgttcggtggccgcctcaacaatgggcagcggggtggcaaagttcgggtcgccgacggaaaggtcgatcacgtcgtccctggccgccgctaagttgcagacctcggctaaaatgttgcgctcttcgtgttgggaagtttgactcaaaattgacttgtccatactatttctcctcaaattttaatcattaggggaattgtaccctactcccgggtgaaaaacaagtaaatatacgtaatatagttaataaatgcggcaattattgcatttttatgcgtgttgataccatttgcctttcccctgtcgtaaagatggtttctccccaccactaaaaaagcgcccttaggcactttggtcttgatggatccgtaaaaaggcgataatcaactcggccaccgccgtcggtgagagcttatccgtgcgaatggtgaggtcggcacaacgatcgtaggcggggcggcgggcgtcttggaggtccgctaactccgccggggttagcttacttgctagtgggcgcccctccccgtcccctaaccgccgggcggtctcgacggggctagccgtcagcaagattaccggggcctgggcgtgttcaagcagtcgttggttacgttccgccactggggtcccgccaccggtcgctaagattccctggcgccgcttaaccacctccttaagggcgctgtgctccaggtcgcgaaaactcgcttcgccgtcgtctgcaaaaatttggggaatcggcttgcaagctgccttctccacttcgtcatcgaggtcgtagactggctgctgtaaggcctcaccaagcagggtgctgacggtggtcttgccgctacccatgaagccaactaggattaagttcattcttggtccccccgttcaatgatttcgtaatcgttgaggaccccagcggcccgcctttgatcggcgggggtgctgaaggtcagttgcaagaccccgttaatttcatcccgcagttccaacacttgcaagtggatgacgttgacgttggccgccgctaaacggttcatgacgccggcaatcgcccccacctggtccggaatgttaatgaagaggtcgtaaaaaaggtccttactttgttggttgagtcggttgcggcgcacccgggccttggaaaaggtttcaaacagccccgcttggtcttgcttatcaatcaggtccttgaagcgttgcagctcccttaggtaactggctaactgttgggagatcaaatcacggttggtcgccatgatcgccgcccacattgtcggatccgaagcgacaatccgggtcaccgatttaaagcccccggccgccacccgttcccctagcggttgccccgcaaaggcggtcgccgtttggttaaccagggccgtcgcaatcacgtgggggaggtggctaacctgggccaccaagtaatcgtgctcctcggcagtgacggtcaaccacttcgccccggttccactcagcaggtcttttaaactggcccggtggtcaactgggccggtgggaaccaggaagtaaaaggcgttttccaccaggtcgcgccgactggcttggaccccactcttgtgcgaaccggccattgggtgaccgcccacgaaggcgaccccggcgtcaactagcggttgggcggcttttagcaccgcttgcttggtgctccccacgtcggtcaccaccaccccctctttcagttccattctcgccaggtcagccaggtcttggcagatcgccaagacgggaccggccaagatgataaagtccgctcgttgtgctcccgcgagtccagtggtcgcctcgtcaaccaaccccacttgcagggcgtaatccagtgcggcttggttcggatcgctagcgatgatttgatcctggggatggctaacccgaatcgccctgatcaaggatcccccgatcaggccgaggccgtgaataaagacggtagtcatttaagcacctcctaacttggctaagtcggcaaagaagctggggtaagagaccgccacggcgtccgggtcaatcaagaacagcggcgtcgttgagcggagggccgccacggccgctaacatccccaggcggtggtcgccgtggctatttaagtttggcttttgaacttgccaattggggcggccgacaattcgccaaccatccggacgttcttccacgtccacccctagttgcaagagcagttcggcgaccgtttgaatccggtcggtctccttgacccgcagttcgcccgccccgctaatctcgcttaccccgtctgcacaggccgctagcagggccactagcggtagttcgtcaatcaagtccggtacgtccttggcgttcaccgttaccgcccttaactggctggtttgaattgtcacatcccctaacggctcgcccacgctagccgtctctttaattgaaaggcgcgcccccatttttttcaggacccgtatgagccccgtccgggtgggatttaggcagacgtctttaaccgtcaggtgcgaattagcgatcaccgccccggccaccaagaagaaggccgccgaggaagggtcgccggggaccaggacctcttggccaaccaagcgcgccccgggggtcacggtgatcgagttcgccgcccggtcgacggttaagttcgccccaaaggccttcaagagccgttcggtgtgatcacgggtcggcagtggttcactcaccgtcgttgacccctgagcctggagggccgccaagatcacggcgctcttgacctgggccgaggccacctctaatttcacccgtgcgccctggagggggtgccccaccacggtggccggcaaggtccccgcctcactcaggcctatttgcgcccccaggcgggccagcggtccttgtacccgcttcatcgggcgccggctcaaggaggcatcccccaccagttggctagtgaaggactggcccgccaagatccccatcaaaagacgggtggaggtccccgagttattcatttgaaggggcgccgccggttcaaccaggccggcgattccccgtccaattacttcgacgtgctccccttttcgctcgatctcgacgccaaggtcttgcagggcccgtaaagtgctcaagcaatcctcccccgccaaaaagtgatcaatcaccgtggtcccctcacttaacgccccgatcatcagggcgcgatgggaaatgctcttgtcaccaggtaccgccagttccccgttcaggccccggctattaattgttaacgctcgtttttgcatccgtttctcccttaacttggtacacgctccacagcatctttaagtgaatggttttgattacccggtcggccggcccggcaaaggcctggctggtcagggtataccgcccgtctgtttgatagcaccggtaagcctgccacttgctcgggcagggcataatttccaagggaccctcaacgtttctcgttaagtaatcaatcgtggccgggtggcaataggcccgttgaccacttcgcccccgccgttccaaaatggccaacggggaaagttcggtgattaggctgtcgattagctccaaccggtcaccgtattggtagtgcaggtccccccaactggccccggttggcgttttaaccgccgcgggaattaataataattcaccccttagttccgggattgactggtagagcacttcaaaactggggtggccaaccacctcaagattttcgtggtcagcccggtattgctcggcggcccggtaagaatcggttaccgccggccctaaggtgtgaatcttcatattaataaccccgtagttcttctcgataggccgctaactgttcttgcagccgggccaggttgtcagcgttaaagctgttagtcaaggccttggctaattcgatggcgaccacgttttcaatcacgatcgaagccggcacgatcgcggtagtgtcggaacgctcgacgctggccttttccacttccttggtcaccacgttaaccgtcttgagtgccttgtaaagggtcgggatcggcttcatggccgcgttaataatcaggggcatcccgttggtcatcccaccttccaagcccccgaggtggttggataaacggtggtagccatcggcgtcgtggctaatctcgtccatcccctgactgccggggtggcgactgatctcaaagccgtcgccaatgctaacccccttcatggcgttgacccctatcacggcggcggccaactgaccatctagcttggtatcccaggaaacgtagctcccgataccggccggcatcccgttaacgaccacccggatccaaccgcccagagtatcgcccgcacgccgggtctggtcaattaggtcgtgaagttccgctacccggtcttgagcaaggatccgcaggtcgttttgggtgatggcgtctttaatttcactcaccgtttggggcttagttaggtcggtgtcgaccgggccgattgcttggacgtagccgaccaaggtcacccccaaggcggccagtagttgttcacagacgttgccaaccgccacccggatcgccgtctcgcgggccgaagaacgttccaagacgttgcgcaggtcgcggtgacggtacttcatcccccccaccaggtcggcgtggccgggccggggccgctccaccttgcgtagggtgttttccgcggtggctgggctggttgggtgcatgatcgacgaccaatgggcgtggtcacgatttttcaccacgagggtgatcggtgaccctagggtaaggccgtggcggaccccacccagaatctcaacctggtcgtgttcaatctgttgccgactgccccggccatacccaccttggcggcttgccaaatcggcgttgatttggtccacgtcaatggctagaccggctggaattccttcaataattgcggttccttgggggccgtgtgattcaccggccgtgaggtaagttaacataattttttcctttctagttgcttggcttgatccatgatcgtggtaaaaacttgcgctacggcgggttggtaatcctcgtttgccactaggtcgaccacccgcttcaataccgcccgttcccgggttgggtcaaagaccggcgccccgcttgcttgcttcgtgcgggcaaccgcctcaacgatttcaaacctttgctttaaaagggcgacgagccgttcgtcgacttggttgatctggttacggagctgctctaactcagccatggtgacgccccctttcgctaatcaaaacgacgagcatcagggcgctaccgattaaccccaccactaggtcaccggtcatcaccgcccgcatgctagtggttgacaagaccccggtaattagcggaacggtgaaggaagcaatgctaccaaagaagtagtacaccccggtgaccatcccccggtggtgcgggaagaagcgcatgaacagggtcaaaccgacttgcatgattcccccggcggcactaatcccgaagacgaagctagccacctgcaccatcacggtactggtgccaaccaggacccctaacaaagcgaggacggcaatcacgttcatgctaatcaacaggtgggtctccttgacgttgcgttgtaagagggcaaagatcaacattaccccgctgatcgaacccaggctgtaaagcgacaagagaaagtgggcctgaccgtcggaaaagttcaagctgtcagcggcaaagagggagatccactgggtaaaccagatcatcaccgccatggaggtgtacccgtataagaccaaagcgatcgtggtcacccagtttggtctaacctttttttctccgctgccttcttgggccggactttggttaggcagggggaaggacaggggcaagatcaagacgaagttgatgaccaccagggcggccatggtcataaaggaccagccaaaccatagcccgttggccgttagttgggcgatgagcagtggcaagacgaactcgccagccgacatgaaagccttgattaagatcgtggccgcgccgttaccgccgtttagttcaacgaaggtggtgtaggtgccggcatcgagggccgagttggcaatcccggccaggatcgcgaagaagtaggcgacgtaaatgttgtggctgaaggggattccgatcgcaaaggctaggtaggcgctcatccccagtaagacaaaggccttacggctaaataagtcagctaaaaaaccggtaatcaggtaggacaagaggcgcccgatcccaactcctgaaataacaaaggagacaattttcagggggctgttccaagccgcccccaggctagtcatgttctgggccaagataattagcccgaacccgtgaatgaagtagttgatgtacagcgaccaggccaagcgggcccggtgaatggtgggtgccttgacggttaaattagattccatgttcattcctccaaaggtataaaaaaaccggctaaactaagacgttgctcagtctagccggtaatcaccaaaggaaatgaaagtgagagatgtcgccaccattccttgctagactgccctagcaaggaagtaccaaaaacccttgcttaggtctgaacgtcgtcgtccggacctaagcggtgcggacgctattcgaaataagcaaaggaaaaatagctgttcgtaaggtgggttaattgattcatggtggtgttcctccttcaagttgataactacattaaaacattctcatttaatctcgtcaaggatcaattcttattattttattctaatcattcgcaaggagtactccggtcgacacaccgccagctgttggttggtttccgcaccacctttgtgtagtgcgtcacgtctttcccccctaattacacgcaaaaaagggaccaccctcaccagagcggtcccctttaaattaatgaatattaacgtggcaaaattgctagactggttacctgagcgcaactaatcaactagtcgtttttgcctaatcaacgccacccattaagttgtggatccgtttaacgaagaacatcaggatgatcccaaaggcaatcgaaacgacccccacggcgatgaagtacggtacttcggtcgccgatgagtagtacttaacgatttgggcgttgacggcttggccaactgaatcggccatgtaccataaactcatcatttgagacttgaaggccttaggggccaacttggtcgttaccgacaggccaattggcgagttcagcatttccccaatttcgactaagaaccaggaaccgaccagccacagcggtgaaacccggccggccgttccaaagagcatccccggaattgccatccaaacgtaggataacccggaaaagaccaacgcccaagcgaacttccccggtgaagtcggttgctttttccagtggtcccataagaggacgaaggccggcgtcagtagcatgataaagagtgggtttaaggtttggaagttagcggcggcaaagtgccaccccccgatgtgcaagaccgtccgttgctcggcaaagagggccaagaccacggaaccggactcttcaatcccccagaagatggcggcggcaatgaagagcgggatgtaggcaaccacccgcttgcgttctaacttagtgaccttctttgagtgcagcatcattacgaagtaaacgattggcatagcaatggcgatcaccgtgattaagttgatgacaccgttaacgttgaagctgtggaagacagccatgagccccaggaccgccactaaggcgatgacgatcaccgccgcccacttgattaccgtctttttctccgcttctgtcagcggatcgtccggggtcaggctaccttcgggtaagtactttttaccgtcccaaatgtattggagcaagccaaagaacatcccaatcgccgctagggcgaagccggcgtgaaagttttgctcgctaccaaagaggtggagaccaaagccgccagcggcccacggcaccgcccacggggcaacgacggcccccaggttgatcccgaaaacaaacatcgaaaaaccagcgtcacggcgccggtcgttttccgcatacaagtccccgaccattgacgaagcggacgggtttaacagccccgacccaatcacaatgaagacaattgaaccatacagggcgctcaccccaaagggcaaggagaggcagatgtggcccagcatgatggaaaagccccctaaaaaaacggtccggcgcgttccccagacccggtcggccagccagcccccgacaatcgtcgaaatgtagactaaggagccataaattgacataatcgaggcagccgtagtctggttaatccccaggccgcccttagtaacggcgtaatacatgtaaaaaagtaggattgcccgcatcccgtagtaggaaaaccgttcccacatgacggtgaaaaagagggtcgaaagcccccgcggttggccaaagaaggccgtatccgtttgtcgatccattagatatctcccatctgaatgtataactattaacaatgggttcaattatacaaccattgcatattgggtcaagagaatgggcttagttgaacgcttccaagaaaaaaataccaagaaattcaccaaaatcacttgcattttagaacgactccgggtaagataattaagtaatttaattgggctatagccaagtggtaaggcaacggtttttggtaccgtcatgcgctggttcgaacccagctagcccaatagtatggcggtcacggtttcgtgatcgccattttttgttattaaaggaggaatttcaatgtcattaccgtttcaggcggtcacctttgatatggacgctaccttcgtccacgacgataagagctacgaccacgcccgttttgaacgtatcttatcccaactggaggaccagggggtcaaggtaatcgtgtcgtctggcaaccaatacgagtgcctcaccaattacttcccggacactaaggagcgcctctacttcgtgtccgaaaacggcgcccacgtggtctaccaaggccaagatctggtgcagaccacggttgagcaagccgtcgctgacgaggtgcttcggttcttgtgtaatgacttgaagctcaccccttccctctccggggttaagcacggctacgtttacgctaaactccccgccgcgacccttaagcgccaacaattttacttccccaaccacgtactggtcgacgattacaaggacctgccggccgatcgctactatcagctctcctttttactggacccagctaaggttgacgaacaattggccgccctacaggaccgctttggcaatcaagttcggattaccccgagtggtaacggctccgttgacgtaaccgtcccggggattaacaaggcgaccgccctcaacgacttgctctcctcttggggcctttccggtgccgacctgatcgcctttggtgacggcggtaacgacgccgagatgctcaagctcgctaagtttgggtacgcaatgaaaaacgccggcccggttgccatcgccgcagctaaccaccttacggcccttgacaacaaccacgacggtgtcttggccgtcctagaagactacctcaccaaccaaggctaaccccaaacccctccaatatgttacaattaaagttacacaaaggagggatttttatgttgattaccgtcaccggggcaaccggccacctgggtcgccggattgtccaccaactaagcaaaactctttcgcccaatcaaattcggattggcgcccacaaccctagcaaagccgccgctctaatggaagctggctttcaggttgcccacttagactaccaagatcccgctaccctgacccccgccctggccgggagcgacgtggtcgtttacgtcccgtcgttaacctacagtttgaccggccgggtaacggaactggagaacctgttaacggcgatcaaggatgctaacgtcccttccatcgtcgcggtctctttttttgccgatcaagccaataaccccttccggatggcgcccttttacgcctacttacctccccgcttagccgggagtgggcttaactacgccgtcatcaaaaacagcctctacgccgacccactggttccttacctaccggaactgattgaacggcagaacgttatttacccggttggcgaccaaccaatgtcttttatttcccaggaaaactccgccgaggcaatcgctaaggtcgccttaacccccgccctgcgggatcaccaccaaacctacctccttagccagtcaaccagcctcccaatgaccgaactagccgccatcatgactaaggttagcggccaccaaattggttaccagccggtttcggttgctgagttcgcccggttataccgagaagaaggggatggtgacgaactggcctcgatgtaccaagctggtgccatgggcctgttgagcggaactagtgatgacttttggaccatcaccggccacgcccccacgtcaatggctgattttttggccgctaactaccgccccaaataaatgataagaaaaaaagctggagacgacgccgtcttcagcttttttagcttccctcacttaatcaacggcccgtcgagtaggttggggcgcactcactcctattttctccataagaagtcgatcaggtagcggtcgacctgggcgttgctatgcagtttggagtgttgtgcttgcttaccagtaaaacggtgggcttggtatgacttggcccggccgctcaccaggtacttaagcgtctcactggaaatgttggcaacgcggccgtcgctgccgttaccgatgtcgccgtacaggttgaggaccgccgcttggcgtgggtagacttggcgcaacttcaaaagctccttaaagctgtccgtcatcttgttaggctcccccgtcttttggttgatagacaagcccgccggttggtcgtaaccaagaatcccgtcgaagtgaccggcaatgtctacctgtttttttagctggggaagtttcttatcgttggcattattaaccaggtaaaaggtaatcgccatgttccccatcgagtggccaaccatgttcatctccttaaaaccgtacctctcttgaagggtaacaaccacgtttttagcgtagcgagcgtctacttggtagtcggggttacggttgtcggcgaagttgacttcgacaattgggttgatggccccctttttgatcgtccccactaggttaaccgtcccctgcttagtgacgttagcgcggatgatcgtcttggttaccccggctttttgcgccgctttggccatgtgatcttcggcgttggcgctggagccatagccgtggaaaaagagcgtgggcgtcgttgattgaacatattttgttgaatttaattgcctagcttgggcccggactagccaggtccccgctagcgctaagacacaaattatggcaatcattattaccatgcgccgatttttattatttttcatcctaacttctcctccactcacttgtataaaaacttaaatcgccgttattttatgaaaaaacaacttctttctctaaattatcgttaacggtttcatcgttgtcaaatgcccgttttaaggcaacaataatgcatagggggcattaattagttggtaaagattttcttaaagatgagaaacttttaacttacgaggctaaaaaaactatggtaatgtaatcaattgtgaaatcaagagaaggagttgtaaattaatttatggaaaacgttcaaatggaacaagcccatccacgtaccacctcagcaagccgggttcggcaccctaagcttgccatggtttcgatgcttctcggcgcctttgtcgggatgttttcagaaacgtccctcaacattgccttaccaaagttgagcattgcctttaacatgtcgactgccactttgcaatggttagtaacgggttacatgctgattattgggatcatcatgcccctttcatcaatcatctcaaagtggttttcaacgcgtaaaatcatcatctttgccttattggtctttattttagggagtgtactttcggctatggccccaagctttgccctcctattaaccgggcgtatgatccaagggatcgggaccgggcttattttgccgctaatgttcgccgttgcgatgcaaatcttcccaccccaaaaattaggggccgtaaacgggatcatggcattggtaatcatgtttgctcccgccattgggccaaccttaaccgggttgatcttagggattgcaaattggcgttggatcttctggtccttcattcccctgctcgtgattgccttaatttttgcggtcatggaactggaaaacgtcggtcacatcagcaagccgcgtgttgacgtattatcaatcatcgaatcaatcatcggtttttccgggattgttgctggggcgagcctttctagccgttacggttgggctagctggcaggtaattgttagtttagtaattggccttgtcgtcttattcctttatgtacaccgtcaactaacgttagaatcaccaattctaaacctgaaggtcttaaagaacaaagaattcaccgttgggaccatcttggtaatgctggacttcgcaatcatcctgtctgcaatgtacctgatgccacaatacattcaaaacggggtgggaattgccgttgccttaactggggtgatcatgcttcctggtggggtgatcaacgccgtgacctccgcaattgccggtcggttatacgataacattggtgcacgtcggcccgccattctcggttttatcatcgcctttatcggggccgttatgttagccatggcttccgataccgcaagcattgtttatatcatcgccgctcacgtaatcttaatgatcggggcgcctttagcaatgtcgcccgcccaaacttccgctctgaactccctgtccggacgggaagctggtgatggatctacaattctcaacacgatgcaacaagtcgtaggtgctttagcaactgcctttgccacttccttcttggaattgggtcgtggagcagccaccggttccgccgccgcccgctttacggcgggaagccacaccggtttttactttacgattgccttaattgtcgtcgccttcattgtttccttccaacttaaggatcgccaacggggccactcaattaaacttgacgaaagtgctaagaattaactatgatttatatcagggaccctacattgggaacctgatttttttgatcattgggaggattaaaaggtgcgtaaattaacaactgatggtaagtggtttgacgttcgctataacgatgaattagatgacgacggcctggccaacgaaatgtcaatcgtcccccgggaccaccaactcttcttgttactatcgaaccaagccgtcactggtcaagaccaagttgacgctacctattccattaccaaggacgaagccatcgcacttcgcgactaccttggtaactggctcaagtcagatcaataacgatacttaaacctaaaaaggggccaggagaaaatttctcccggccccttttaaaaactttgaatgttacacagcaggcttagcaagcccaatccaccacattggccagccgcttttcccgagggaccatggtgatcggttaagaactgccaattagcggcaattttgacgttatctccagtccttacttggctcgacgccgtttgaacactagggtggccaaggctgacattagggtccacccaagccctaccaagctaaccttcgcccccagcgtcagtcctggtacgtgatagcgtaaaacaacgcggtggtgtcccgctggaagccgaagccccacgaaggcctggttagtacgtagcaacttaaccgcctttccgttaacggtggccgtccagccgctcgaataagggattgacgaagttaaaatcccagtccggttcgtcgtgatcgtccctgacacctggttagtcttgaaagtaaggtcctttagggcgtggctttgaatggttttaacttgttgatcatactgtttacccaacttttcggcttcaaccgtatactttagccggtaggttcctagcttactgaaggtaacgccgacactttggggaagctgaccaccaaagtaccctaagttcaaagagccatccgttactaacttaaagaacgagaggattgactgcttgggttgggtgattgtctcttccccctttgaagaagtgagcgtaatcgtaaacgacttatcgggagccccctttaggactagcttacgccaattttggtagcgggcaaacttagcgttatacgttgagcccgggttggtcagcatgtactgatcgtgggccgcctcgtaagcaagctcttctttcatactgaagggggtgaacttaatggatgaaacgtcaacgtgcaactcactccccttggtagctttagccacggcctttttagtcaggtccgggaaggtcaagcgataggtttcatctgggtcggtttgaaccaactggctagccttgaccggggttaagcggttagaaatcaaggtggcagttaacttcttaacctccccagcgaggttggccttctttaaccccttaatagcgacttggttacccgccaccaccaccccacttgccaaggcccgctccttttgggtcgccgataacttacggtaggtcgcttggctgatggcggtgtcttgccaatacaagagcgggaaggcgtttttggtcgtatagcggctggtctgaatcgtcgttagatccgccgccgtcttggcattgcttggttgcccctggtcgtaattgatgatgggcgtcgtggttttatccagggtgtaaccggccggaatcttggtggcgttatcgccattagactggacgaagaggtacttgacccccaagaagttgtttaggaccgtccgatcgtcgagttggttgagcggaatgttagattggtactgcacgttacccagtgaccgtgagaacgccccgacgtacttattttgaagtgaatagtaagacttaacggcgttcaagccactggtcaaatcgttgtacatcttcaacgaattgatgatgtcattattggagatcgtgttgacccggtaaaaagacttttgtgccaggccctgatttaggcccccgtagcgctggctggtaattgcctggtactggccccgggtgagcatgtcattggcaaagccaccgttatagggtaaggcagcgtacagggcgttaaagcagacgttagctaagattacccctaatagccagcgttcgctccccggccccgggtgaccaattgcccgggaaataatcatcagggacaccaacaagaagatgaccggcacaaagaggtcatcatcattttggaaaaagtaggtcgccaacagaactagcaggtagcccccggtggccagtatcataatcctgagggttctttggtctaacgtggggacattttgcaataagacgcagaccgtcatcgccagtggtaagtaaattaggagcgtccaccggttggaagccgacatcatcccgttgaaaaaggccccgcaggctggaatcaggagcatcaccaaggaaagggccaaactgatggccagcagggggtattgccggggacgggtgtagacgtagacgatggctaagaagacgattgccgccagtcccagcgccgaccagaacatgaaggtcgtgtccccaccgttaattaattgcttaggtaaaaagaggtagtagtacagcggataggtcttcaggccgttagcgaactcggcccccgcccgggtcgagttttgaaccgccagtagctctggaactaataagaccgccgctaacaaaatggaggtcacggttgcaaagactagcttaagcaaggtctttccgtagtcgagggcacggcggtagtgagtggccacccgtaagaccaagtaaatgatcgtccccacccccaccacgaaggcgaggtagtagttagccaccagcatccacaagaaggccccagtcaagggccaagcactccccccctttaagacccgttccacttggatgaccaacagaggaaagagcatgaaggtggtggtaaacattggctgggcaacggccacatacaaaaggtaagagttaaccatgtacaccgccgttcccgccaggatgacccggtcagaaaagtcgaagtgctgggcaaagtaaatgaaggccaaaccaacgcaatacatccgcaagacgatgatgacctggtaggccaaggtaatcttggccgccggaaataggaggaccaagtaagcgaaaacgtcgccaatcgtgtaataagaataaacctgaaaggtatcggtgccgatccccatttgccaagaccaggcttggtgacttgaaaaggggtggtggagccagttaagtacgatctcccggtacttagccatcagtgggaggtgctggtttaaggcatccgtgttccaaatcagggtgtggccggtcaccacgtagcccccaaacattgccagggcaattaggccaaacatcagggtgtatttaagatacagagtgccaagtgggcggcggcgaaaagaaaagtccataattatacctacttcaaaaaattcataaccccttcattttaccgcatgccataacggctggggggatcttaactaaaaaactagttaagaatcgtttacgaacggggcacttggccagttcttttccttgctaatctttttcctgatgtaagtatagctggtggctacgggggaactcgcgtttaaaggcttgtagtagggcgtgttttgcttgaccatcgctaaggttaagggagatttgtccggtgtaaaatccccgctcgtcgatcactacggccgccgtcccccgctcgatcgttagttggcgatccttcttgcgggttaacagggtgaccttagtgaccggtcccgctttggccaacgccttcaccaggcgttcggcctgcttgacgttaatactcttcatttgctgacctcccgcaatacccggctcacttcgctggtgaaggtggccttttgtaaactagtagaaataaaccagatccgcgccacctggccgtctaggatgaaggccacccggactgaaccgagtttagccaggttgcagcggagctcaaagcaggggcgcccggccactggctggcggagggctaacttgacctttgtcagcccagtcgcttgctcccgttccaagattgccccaatgcattccttagctagggcttgactgccagcgtgctttgtcaaccaccactgactaaagtcagtggcttgtgagccgaatatcatcacggatttcgaaccacaatttgcgtagatagggacaacttatttgaccaactgaaattgtaatcaaacagcggtcgtctaattaccaacgccttttatgtccccaggttgccatagggacagacaagctaggctagtttagctattcccttatcaagaatgtttttagctgcgttccagtcacgaatatggtgaataccacagttaggacaagtccagtttctatcatctaatgttagtttgtccgtcccattagtgcccattacaaagccacaatcacgacatgtttgggtagtatttcttgggttgattgtgataaattgacgcccataaagctttgctttataagccaacatgccaagaaatgttcgccagccaacgtcagaaatactaagtgccaaagcatgatttttaagcaaattcttgctacgcaactcctcggttactactaaatcgtggttcttgattaatgcggtagaaatttgttggagaaaattatgcctttggttcattaccttggcatggagtttagcgactaacaagcgctgtttttgataatttttactatctcgtaaagaacgatgttctttttttgcacgttgttgccgtctagataaaatgcgctgttctttggctaatttgcctttaatagtgcggtaatatcgtggattaggaactatgttgccttcactgtcggttaagaagttatcagtattaagatcaattccaacatgtccatgagtagctttggacactttaacaaaagattcatctgaagctaactgcattgataaaaagaagcgatccgctgaatctttagtcaacgtcacggtaccaattctagtctcgcatattcttttcaaaagccgtgcttgcgaaccggcaacacgtaacagtcctattttaggtactttgacatgactattatctagaaaacagactgtaccgttagttagcaacgcagttttttgccccgggtattgacaattggtttgataccgccagtgataactctttcgatgaaatttgggaacgccagtggcgtgaaccttccgaaaagcattccaagcttttcgatagttctgaatggcattagctttcgtcaaactatcaattcgtttatcttctaagaattgatagtgattagacatttgcttagcgttttggcgcatagttagttgcttaatacgatcctgaactatgtcaatcggtagcttaactctgcgaagctgcatcagttccttattgatcgcaaccatttcgttatagataaagcgactagcgtcactgttgattttaatcaactgcttttgttggtcactaggatagcagcgcatttttaggccataatgatatttcattttcgacattgacttcatttgatttcacctcctttattgatatgataacattatatcatgatgtcaatgtattaacaaaggagagcatattatgactaaagaaaaaatcaaagatgccatttatactcgtcgttatatctataatttccattatcatttgatctgggtaactaagtatcgcaatcagacttttacaaccgaggtcttatctaacgaaatgaaagctatcttgcagcaagttgcagatgacaatgacatcgtaatcgaaaagatggaagtcatgccggatcacattcatatgctgatcagttttccgccaagcaaagctccggctagtgccattaaggcgctcaaaggacgtagtgcctatattttttttacagaatcatccagaaatacgatgtagccaatattggggcggtcatctttggtcgccgagttactatatgagtacattgggcaatatgagcaaagaagttgtcgagaaatatatcaatgaccaaaaatatacagaaacaaacaaaaagccccataaaggggctcaatagtggcctatccatcccatgactaaagtcacgggatttccggctaatattaattaaagaagggcttggttgttttttctaaaataatttccaccccaatttcccctttctgattgtactttggtcccgcatagcatatgattgatttcgttaatttgccaccattatagcgcaagaagggcttttcttatcagccctggcaaattggattaaaataatagtaatcaatccggctatttaccgggaaacgaaagggaattgtcatgcagcaaggaaagaaaaatctcgccctgatggggctgatcaccattgggatcgtttacggcgacattggaacgtcgccactttacgtaatgaccgccctgattaacgatgctggcggtctcaacaaacttagcgaagactacatcattggttgcctctccctcgtcttttggaccctaatgttaatgacgaccattaagtacgtcttggtcgccttacgggccgataaccatggtgaaggggggatcttcgccctctacgacctcgttcgtaagcgccgtaagtggttaatctacccggccctccttggtggtgccgccctgctggccgacggtaccctaaccccggccgtgacggtgaccacagccattgaaggcctcaagggggttgcgcttggtccggctaccccgattaacagtcaaaccacggttatctgggtcacttttacgatcctgttaatcctctttttaattcagcgcttcgggaccgtcttgatcggcaagggcttcgggcccctgatgctgatttggttctcctttttgggggtctttgggatcgccaacttgattaaagaaccgctggtggtacgcgccctctccccccactatggtttaatgctcctcttttcgccggaaaacaaggtcgggatcttcatcctcggctccatctttctggcgacgaccggggctgaagccctctattcggacatgggccacgtcgggcgccaagccatctacatcacctggcccttcgtctttttgactttaaccctcaattactttggtcagggggcctatttgatccataacctgggccactttaccaccactagttcggcctttaaccccttttacgaaatgctgccatcctgggcctacttatttggggttgccatcgccaccatcgccgccattatcgcttcccaggccctgatcaccggctcctttaccctggtggaagaggcaattgggctcaagctcttgccgaagatggcgatcatccacccgtccttgtcgcgtggtcagatctacatccggacgatcaactggctactgtgcgcctgcacaaccctggtcctattttacttccggacctctgagcacatggaggccgcctacgggctcgccatcacgatcaccatgttcatgacgaccctcttgctctaccaatatctagctagccggcgccaccactggttcgccctcccctttgcttgcctctacgccgtcatcgaaatcatcttcctggtttcctctttaaccaagtttgaccacgggggctacgtgaccctcttcatcaccctggtgatcgttgccatcatggtggcctggtactttggcaacaagctccgcgacttcttggatggtgaaacggcgtggacccacctgggcgattacaaacggaccctccaagagctaaccgatgatgaagcaattcccctgtacatctccaacttggtcatgcttaccaaggtcagagacggcgacgccatcaagcgtgaggtcctctactcgattctagacaagacccccaagcgggctaaggtctactggtttgtgacggtcaacaccaccagtgaaccctacaccaattactacaccgtcgacatgatgggcacccgcaacatcgtcaacttgcaactttacctaggctttaagatgaaccaccatgttcccttgtacctgcgtcaagtagttaatgacctgatgcgccaagggatcatcgacccgcagccgcaaaagtacactaccacccccggacgccaggtcggcgacttccgcttcgtgatcatccaagaccagctatcgtctagtacccagctccggggctggcaacacctcttaatcggggcgcggatctttatccaaaaccactccaccaccccggttcagtggtttggccttgaattctcccaggtgacggttgaaaaggtccccattctcttgaaccgccgggccgccccaatggtcaaccagcgggccgtctaccaccaaaaacccaaggaatagctgggtgggaaataagcttcagaactaaaaaaatgaggtcgggaaaacatcttttcccgacctcttattgtattcatgaatgttagacaggtaacgtggcaaccaaccgcaggcctagtgcctaagtacgggcgaagaacaccgcgttcttgcgctaacctgcaccctagcttagtctaacggcctgccaaggaggtggttggccactcactcctgttttattcacctgtcgcttgccagtactggcggatcattgctagctcccccaccgattgggtgtgcaggtcaaacttagctaattgagcttgcaccactcccacttgtgcatccgccagcgggttagctagcgcctgggcttgacaggcgtggatgcattggcaagccgcttgctgggccaccactgaggtatagggttccatttcaagcacccactccgggtgggtttctacttgagtcacccaccgactaaccccgcgccagtaagcaacttgttggtgcggaactcgcccggtggttgttaagtcggttacgaccggctgccagctcgccattagtgccagcaaaaagttctccgtgaccatcagtcccgctaggtggttgtgatcaatgatcgcctgaattctaccagcaagctgccggacttgccgtaccgttacccggatcattcctcagcaccgtggctaaagtagcgaacggcatctacggctcgttgccatccggcgtagtgacgcccagcctcttctttggtcataaccgggtcaaaacggtcacccgacttagccaactgcttgagctcgttttgatcctcccagaagtccaccgccaacccagccaagaaggcggcccctagcgccgtggtttcttcaatttgggcgcggacaatcggcgtttgtaagaggtcggcttggaactgcatcatgaagttattgcgcgacgccccgccatccaccgccagggtggtcaacggtaaattggtgtctttgaccatcgtgtccacaacgtccttggtctggtaggcgattgcctccaaggtggcccggacaatattttcccggctactcccccgggtgaggccaaacatcgccccgcggacctcttgatcccagtagggcgcccccaaaccggtaaaggatggcaccacatacacgccaccggtggtctgggcatcaacggccatttgctcagactccccggccgacttaaagagccgtagcccatcgcggagccactgaaccgccgagcccgctacgaaaatcgacccttccagggcgtaatgtacctcgttgccaatcccataggcgaccgtcgtcaggaggccattttgcgaaagcattggcgtcgtcccggtgttcatgaccgtgaaggccccggtcccgtacgtattcttgacgctccccttttcaaaggcgccctggccaaagagggccgcctgttggtccccggcgatcccggcgaccggaacttggaccccgaagaagtggtaatcggccgtgtaaccatagacgtgcgaggacggcttgacctccggtaaaatttcccggggaatatcgagcaggtctaaaatgtcttggtcccagtcaagggtgtggatgttaaagagcatcgtccggctggcgttggtaacgtccgtagcgtgcacccgcccgctagttaaattccacaagagccaggtatcgatggtgccaaagagtaggtcgccccgtttagcccgctcccgggcccccggtacgttatccaaaagccacttgatcttggtggccgagaagtaggaatcaatgactaagccggtcttttggtggatctggtctgtgtagccctcctcgattagtcgttcagcaatcggggcggtctgctttgattgccacactatcgcccgggcgattggtttaccggtcttccggtcccaaatcaccgtggtttcccgctggttagtaattccgatcgccacaatccggtagggcttaacttgcgccttgatgaccgcctctgaaatcaccgattgaacgctatcccagatctcttcggcgtcatgttcgacccagccgggctgggggaagtactgacggaattccttttgcgcaatcgccacttctttacccgcgtggtcgaaaataatcgcccgtgaggaggtcgtcccctcatcaatggccatcacatattgttgctcattcacgctcgttcatcctttctaggtaggtaacaagaaaaaaagggctccgcataacggaacccccgggtctttacttgtcgctagccatcttgccggcaacactgtaacggtcgggccgcatttcgtttaagacaatgtggatccgttcttccggtacgttggcgttcttagcgatggcagccgtaacgtccttcactaacccctttaattgttcttcgctacgtccttcaatcaggtcgatgtgtactaatggcattcgtttggcctccttaattgcttgttttgattttaacatagccagccgtcgccttcaattgagcttagtttgggcgggcaaattcatcgcgcaggttggccaccacgtccttatccttcgcggtaaagataatccggtcaccatactcgatcaccgttgtgccatggggggtcaaccaagtcccgttacgacggatccggctgatcgtgatttggtcaatcattggcaagtccatcagttggatgccactgtaacggtgattcttcacccggacttcaaataggccggcctcggtgccggtcaacagttgcatgattgacggtgactcgatcagggcccgtaagaccgacgcctgcacgttgtaagtattaaaaatttcgacccccgcctcaactagggcttgagtctgctcattagccgtccgcatcgaagactgattggcgatgacccggtcaacccccgcttccttggcccccaaggcgagcacttggttacgctcccctttttgctggccaatcaccaagatgtcggtcgtcaaaaagccggcttgcttcagggtcgcaaggttgagttgttcaaggtagtaaatgttttgcagttcggaatcgtaggtgtggtaactatcttgatcatcggtgaccacccggacgtcgtaccaattgcgttctaattgctgggcgattgggatcgtcataacgttagccccaattatgacgacccgttgcttgatccggtccgcctttgccaagcggaaggtactattgaagaccaccggggcaaagatgcagacgatcaccgccgccaaaacgaaggcatcagactgggtttgggtgatcgaacctaggtttttggctacctccagcgatggcagcaccaaggtaatcgtggtaacggtcaaaaaagtcccggcaaaggaatttcggttgccaaaccgctgccggtagactaaaaaggtccccaatttagcgatgaccaacccggccactaaaatcggaattaacatcagggcgtggggattaaccaacagttcacgtaggtttaacttagccccagtcatgatgaaaaagatcgggatgaaaaaaccatacccaatcgaggtaagcttgtcttgggttgattcatagggctctaataacttcattaccatcccggctaaaaaggcgcccaggatgttttcggcccccaccgcctcggcaaccaggaccagggtgaaaattaagaacaccgccaaccggatatccaactgggtggtcgccttggtgacccggttaaaccaactgaagtgacggtgaaaccggtgtaacaaaataaccgccactactaacgggatcacaatcaaccagattttggtcgcatcacccccgcgaacggaagcgtacaccgtcagcaagaccaacggtactatttcccccaacaccgcggttaacaaaatcgtttggccgattggtttactgaggatctccttttcctttagggtggcaatcaccacccctaaggcgatcgtggtgaagatgatcgttgctaagaagacgtcgctaaagagccccaattttcgtagccctaaagccaagccaaacgccacgatcaaactgaccatgaaggcctccaccgccaacttgactggtgaggcctcgtgattggcacccttgcttttttccggccggaacagggaaaaatcgatctccatccccgacaaaaacattaacacgatcacccccaccgatgacaagaggctcaggttggtggtcgtgttaaccacttgcaagccgctcttacccaagatcacccctacgatgatctcagccaccgcggttgggaccccagtaatttgaaagcgggccatcaagatggggattaagagggccgctaaaatcacaataaacattgacaggggctggctacttaccgcactcactgccattaccaaactttccatattcatcccctccgccattaatgatcacccgggaaatatccggttctgctttagattagctttgtcacatcaatcactcggtccgtagctaggaacgggtgaccgtcactaaaggttttcgtcagtcttaaagttaagcgggctgtaatccgtcattttggtcagtaaacttagtgataggtcccggtaggcattgagggcgtcggtcgcaaagttgatactttggcgggttaagtagtttgcccgctccgttgccgttttcagctcctttaagtgagcatccgtttgggcaaccattttgacggcgttaacgttaagttctttttgaaccgcctgcaggtcaggtaagaaatcgtgatagtggctgtcgactaagacgcccgcctccttataaatccagtaagcggagttgcgttgggcgggcaacttaccgcgcttgtatggggccggcacgtcatcaatcccggcaaagaagggtacgtaaacgctttgggccgcaacccccagtgccaaccaatgaatattggcgccgccacgattcatctgcaacaggtgtgactcctgggtcttggctaacgaaattggccggtagcggtgcttttcctcttggctcccgcgccccaccggatcaaacggcgttccttggtagtgggaggccaggtagcgttgggcgtccaaaatgctcagtttacgatccggttgcatcaaaaatggtaggtcctggtcttctggttgttcggcttgggccttagacttcgagaacagttggtgaccgtaccagacccgcggggtggagtagatggcatcggcccggtcgtgagtgccaaaaatttcccggaagttaaagccctcttcatgagggttcaagtggtgttcggacacaaacgcctgaattccggggtggaacataaagttatccgggtcgttaaagtcaacttcttgaattgccagttggttgccgaccaccgcataggcgtcatcggggatccgttgggcaacccagtagtgaccgccacccgtttcaaagtaccaggcttcatcgttatcggcaaagaggaccccgttggtttctccagtcccgtgctcggcaattaactgaccaaggcgggccaccccttcccgtgccgtttttacgtaggggaggacgaccgtgatcattgcctcttcgttaaggccgttttccaccagcgggtcgtatcccagcaccagttcattggtgtaggcgctctcggtggctgacatcgccacgtcatactcgttaatgccgtcctcttcaaagagcccgtccttatcggtccactccggggtcgccatgtattgagcgctgtgggccggtagttgcaaggtcagcttcgtttctttggaaataaagaggcgttccatgctatcgcgagggtgaatttccacccgtttgggccaggccgccttcgcatcttcgttacggccaattatgattgtgccgtcaatcgtcgctttcttcccaatcaaaatactagtgcaagcggagagtttcttaatcatcgtatcatcctttctcgtgcttagttgctactcaactggtttggccggttactgcggtttttgctgcctggccgattgccattttggttcaagatgtattccttaatcagggaaacgatttgctggttttggggcaggtcggaatgttgggcgtcgtttccggtgaccgtcatcgtcgtatagtgcttaaccaccttttggtagatgtacttaccagcttccacactcccctccggcaccaagccgtcggagttgtaggtcttcgttcccatcactgataacaccgttagggaactggggatcatctcccgatcggcaatcaggtcacttaacatttgagttttattggaaaccgagctttccgaaaagttatacggggtccccaaggtcatcaaggtcttaatcttggccccgtcagcttcgtcgtaatacttttctaaccagaccgtccaaattaaccccccgttagagtgaccaaaggccttgaagttattgaacttataggtttggaccagctgttcgaaagcctcgttaaacatcttagcctgttttttgatattggagtaaccatcgtggttattttggctctttgtcaaatcctgttgatgggtcattttaggcggcggccggtgcttgcacctggcgccgccttttttcagcttccgttcccatttgatgcaatcggatccgggcgatgaaatgaccaaagttagtaaagccatatgccgtccgttgaattaacttgatcatgcggttgatcccctcaacccgaccgtttgagtacggtaatacggttgcgttgtacactccttcgctgttcttacggagggtcttaagaaccgtttggaacggcgctggcacgtcccatttggtgaacaagaggtccattaattggtcaacatcgtgctcttcaagagcggtcatggcgccctgtaagagttcataaccggccgctaactgaggatcaaggtccaggccaattcccacccgttcggccatcgttaccttttgtcgtaagtggcgatcatagtactccttagtgtagttaagcgatgtgcttttaagtaagtacagtcgccacgaattcttcaatgcccgatactcacgcgtattagggtcgaattgcttcattactgcgacccggacttggttaaacgcccgcgtaagcattgaaacgatgtggaatcgatccacaaccagctttgcgtttgggaagtagcggcgtacaaggccttgatagtaactgtttaagtctgtcgagactgatttgactcgtttgcgctcttttagcgagaatcgatcaaagtaatgcgtaatactactcttaagccgatcagggagaatttggtagatttgtgaggtatcattatcaacgataatgaagcaatacttcccctgcggaccacggaactcatcaatggcaatattagtgggtaaagtgcgactattaaagcgaaggagcgcttgatcactgtctaggagtcggccaatggtactaggtgacacaccggtaaacttagacacgtccttttgagagacattactttcaagcatcgtaagtgccttgtgtttaactgctttggcaatggaacagtatttatcaacgacgttggtcttcgccatgaacgaatcttggcaattcttacatctcaggcgttgcttaccgatccgcaacatagtgggacaactttcgttaattgagaggtacttaatggtttggtaagaatggccattcttaatgaaggtatccgcaaagccgcaatgtgggcaccgatccaatttaagcgagaccgtcccaatgaagacctgcgtctcccatccgtcattattttcaaagacaacgtctgtgaaatgaagattggggtctttaatttgaaggatatttttaatataatcagtcataaggtcacacctcttactttctggaatttgcgtggtagttaataatcagaattttaaggctggtggggcctttttttgtgcgacgaattgtcaaatcaagcgcaactttgtcccgaagaaaacttcaaatggactcttccagcctaagaccttacgtggtcggtgatttaaatccctgacaaacttgtcgatatcttgatcagttagttggtctaggtcggttcctttggggaaatactcacggataagcccgttggtattctcattggttccccgttgttggggcgcatggggatcgggaaaatagactggaatgcttagttcttggctaacttcacggtatcctgcgaattcagttccacggtccggcgtaagcgtccgaacgcgtttaggcgttacggtatgcaggaggtcaatcatcgcttgtgtgacgttcttggcgtttactttgagaacgcgctgagataataaataccgagatttacggtccactaaggttaccagggctgaacgcccggttttaccgcgaattgtatcaccttcccaatgaccaaaccggcttcgattctcacatgaaaccgggcgttcatgaacggaagggacgtcgttaaatcgtcctcgacgttccttaatggttcccttggcctttcgggttttaccacggtgacggagcttacgggcaaagccacgagccccgtgactcttacgtttgatgcctaaattatcgcgttcaatcccacgataaatggtgttataactgatacgccattcgctgttttcgtgggctaaacgacctgaaatctgttccggggaccactgacgttgaacaatacagtgaaggataaaatcccgtaacttcaagttagttagaagcctaggacgtcggctttttagtcgacgtccctgatagttctcttgggccttgacggctgagtaagccttacgaccgccattgcgtttgatctcgcgcgatacggtggctttagaacacccaatcctctgcgcaataacttgataggtgtccttcaaagtgacgcctaatagtatgcattctcggtcttttaaggtaagatggttgtacgaactcatagcctaagatctcctttagatgtttgttgtggtaacttcattttacaggactcaggctatgagttcttttttattttcttcttacttgttgcacttcaattgtaaattcgtcgccctcaaaaccaaaaaatcctgtcaacgaatcaccactatggtaatccatcaacaagatttagtgtagagccgttattttcaaaggctaccacgatgatcggttccgtatcaccgcgccgaattttcccagtgtacgtgatcttgccggaattgtaaacttcaacttttaacaaggagtgtttagtggcgctcccctggtttaagagcttaaccagggtgtcaaaacgatttttagtggccgacgaaccaggaatcataattaagggggacagttgggaattgtgctgggctgctttttccttcgttctactcttaacccaactggtggtgggaatcaaaagggccactagcaaaaagagccccactaacaacacccacaggctccgccgttgctggcggttagttagtttaaacatctttgtggtcctcctttgcatcgatttcgcggatccgcccctccacggccagggaaagccgaacaaaggggatgtagacccaaacgtcaaaggcaagcagggcaagggtgaagagtaaggtaacgaaattaccgttactaccaacgtaagccaccaacggccccggcgtcccatccggcacccagtaaaccggggtcgggattaagtgaatgaagatggcaaaggccgcaattaaaatgttgaccattggcaaaaagaccgccggcaaaatgtagagcggatttaaaagaaccggcaagccgaccattagccccgtgttcccgttaaatagcaccggtaagaagttggcccgcaccatccgttgttcgttataactgtgggccacaatcgccattgcaagtaacagggccaacgcgagcccgattcccccaaaattggcaaaggagttgtaaagagaagagccaaggtaagggtacggtaccccgtatgcggtgtggtgcgccaaggcgtaatttaggttcgccatcgcctccgtgctgtcagttcccagctggaagttgtaagagccgataatccctaaccactccagcaaagtcgtcaggcaaaccatcaagagctcgagccaaaagggtgtgttacccgaactcagactttgcatcaacgccgccgcttgggtgtaagaagaataataagacacgaggtttaagacaaagttaatcgctaaagcgccaagcataatgactaagattggccgggtgtaggcggccacttgctcttcaatgtcgaccgtgtgaattggttgaccgggtttgagccggttctttttccctaaccagcgaaagatttgaccgactaagtaaccaacgagtaagccccctaacagcgagccgtaactcatcatgttctgatcgaaactgaccccgcggttgggcgtgtagcgtaccgaaagcaagaggctagtcaccaacccagtaatccccggcacctggtcatcaatctggtagagctgggcggtgtagcgggccgccccgtaagccgcgtacaccgttagcatctcaattgtgacctgtgagagggctaacagggaatactgcgccttggttaagaccaccttagggacccaatccccgatcgataaaacgttgtataagtatccatcgttagagaaaaaaacgatgaacaatacctgggcgataatgccaattaaggctaaggggaagatgacggccagggtccgtcgtaccacccggataaaggaatgttggcgatagcgaaccgttcgtttaacaatggcgtcaatcataggggctcctccgttctaatgtattatcgtttaagtataccaccccaataaaaaaagggccgggaaagaacgttttccccagcccttagtctattttcaaatgtaacctgaaacttgaaagtatgaagacagactgatcccttggtatcacagggcatattttaattaatttaaccatttagcttgctgttaacagcgaaactaaccgtttcggcaaaaatgtgaagaactgattcatcatctgaataatttgggctcttcttgcataaacttcatgattaataatcgtttttaacgaatttagaagccataccagtgcttgagacaactcaatatctggcatggcttcgttcattataaagaataaatccccaatggtgcgatcatcctgattttgccgctcctgccaagctaataggtcataagtcatcatgacaattgctaaatggccacaaagcccgtcataattttgaacttgtgatttgtcgagccgcaagtattgcttggcaactttaaagtaattctcaatttgccatcttcgggcgtatagttgaatgatcgcttgtggctgaaggcctaactgagtcgttgccagtactaggtagtcatcttgacgggcccgattagccacaaataccaagcgaagcttgaatttttggttcccgacgtgcgcttcgacaaagcagctgtattgataagcttgcttgggttgatattttgaggcctgcagtcgcttgtataatgctttaactgaatattgccgtccgcgatattgatagtaaattttgctggaccgtttaagcatgcccacgccgtttaatcccaacttggttaattcatagaacatttttggtgagctataccagctatcaaataacacatagtcagctagaacgccatttgcgagggcttgcttgacaagttgcaatgaaacgaggttcattttttgctgtgcttggcgacgtctccggccagcaattgttcgttgatcggttgttttagctgattttccaaggacgttttgtggcttcttggaagacattaatgcaaagttgatcggtaagaatgtattggcgtcactccaacccaaagttaaagcccggtatcccttaatatataactgtttgtcatggtcaaagactcgcgctagtaattcggtttgggtggcgtactcacgggaaaagagtgtatcgtcaatgatcaatgctaaccgccgccggcggtcaataaacggtcgtaaatgcttgattaaatgactcccaacttgacaaatcaagcgttgccaattgatccggccatcgttcaaattatttctgacggtgcgactggtaaagttaggtatttcatgggctcgataaagcgagcgtcccaggaactttgtcgtgagcagccattcaatgaccttcatcaagctgatttctgaattccggcgataattcaccaacttggtgagtttagatagaccaatgagggaagtaaattgatgaacaatattgtgaagctcgttttctgtatttttttgtcttataatattcatgacgtaagtctcctttgtatcttggttttggtcgactaaagtatacaacgcaggagagcttgcgtttatttttttgccaaaaaagccaataaccacacgcctttggcgtgattattagctttcaagtttcagtgtaacaaaaaggacggtaggcaaccaccaataccgtagctatcgattacgtccttcctaaacgttactaccaactggcctttttgacacccggtaattgccccttgtgggcgagttcccggaaggtcagacgagacatcccaaactgacgcatgtaagcgtggggacgaccatcgtactgatcgcggttgtgtaagcgaacgggacttgcatcccgggggagcttagacaaaccgatgtagtcgcccgcttccttcagggccgctcttttagccgcgtacttggcgaccgtcgcccgttggtgttctaacttagcaatttttgattttttagccatactttcctcctaaattttaaatttcacgtcgcttcaacatactcattcactcgtcaattcaaatagtaattattactttttaccccagaaattgcaagtgttttactccgattgttgaatttccttaacaaaggccgcgtactcctgtgcgtaatggtgttcctcgctgaccttggccactagttcctggttatgggtatcgacccgaccggaatcaagttggcgccggtagagctccaggtaagggaggtcatagtcgcacgccatttgccaatcttcttccttgtcgtatgcgacgtgacggtaattaatcccggcgatcccttgctcatccacttctaacagcatgtactgcgccctggtatctgcttgcaagtcccactgccggttaaagggttcccccacagagcccgggtttaagaccaagcgttcgtcagtggcgtagcgcatcagttcgtggtgaacgtgagcgtaaatggccacctgagccgtggtcgctgccgtttgaccggagaagagccggtcaaagttttgcgccgggttagtcgggaacaggtcctggcccatcgctaggtcggggaggttgtggcttaccgtgtaggtgtatttccccacctggcgcgtttgttgcagtggccacttcgccatttgttcgaccacccctggttgtacccggctggctacgtactgggccaggcggccaaagtacaagcgcgagggtttcgtcggcgggatccgcccggccaccccgttaatgactaggtcgtcccagttaccacggacaattaacgaggggttgatttggcaaaagaggtcccaaacctcgttgacccccgggcccggcattaaaagatcgcccacgaaccagtagtccgttgcccctaagtgctgggcatcctggtaaaccgctgccaaacccgttgctgagccgtggacatccgaaaagaccgctattttttctcccatgtcttgcacccttccttatcagttctgtggttaggataacacattggtcgttttcatacccaagaaaagtgttagaataaaggggcatttacaacaacggcgataatattatgccttagtggcgtcatagtatcctccgttatgggttctggtggttcggctgcgaacattactgggacccatcgtgttttttaggggtgaaactgagcacccctgcggtcctcagtaaatgatggttaccgggggctggcgtttaatgaccattagaaaggaaatgttaatgcataccgaaattgaccccaacgtccgcaagatggtaacgatcatccttcttgtttcaaccttcattagcctgatgagccagacgatgatgataacggcgctgccggttattcaacacgacgttcaccgctccctcaataccgttcaatggctgaccacgggctacaccctgatgatcggggtgatcacaccgctttcgtctaacctgtacgagtgcttcactaaccgccaggtcttcttgggtaccctcggaactttcatcgccggcaccttactgggctgcgtggcaaccagttttgggatgcttttggctgcccgtttgattcaggcctgcgccgggggaatgctgatgtcgtttcaaatgaccaccatgatctcgatttacccgcccgaaaagcggggttcgatcctcggcctctcttccctggtaattgccgctggaccggcgattggtccgtccacggccgggctgatcctacattttttaaactggcactacctctttattttggtgctccccttcatggtgttggcctgtgtactgggttacttcatgttgcccaactactcaacgccccaccccattcacatcgacttcttttcggtggtcatctctttgattggttccgccctgaccctaggttctttgactaccttcaccgtcaattccgccctcggttgggccatgctaatcagcgggctggtaattttaaccctctttgtccggcgccaattacggctaaccaacccagtcttaaaggttaagattatgacctacccctccttttgtttaatgacgatcgtcgggattttggccttcatggtccttttgagtaccgaacaactcctgccaatctacgccgaaaacgtccgccacaccggctcctttatttccgggatgatcctgctccccggcgccatttgcaacgccatcaccgccttttttgccggcaagctttatgaccagtacggtcccaagtggttaatcaccacgggggggctgttgattctcttggcctccatcccactggtgacgatctcaactcgttcttcgttactgaccctcaccctcgcttacacggtccggatgatcggcaacgccctggtcttttcaccagccctttccgaagccttccgcgccctttctaagcgggagaacagccacgggtcggccttaaacaacaccctacgccaatcatttggggcggtggccgttaccatgtgcgtagtgatcgccgacatccccgcctccctggttgccgggatcaagctcgccatgtgggtgactgtattattagccgttttgatgttacttgtcttttggtcttacctggcctaccaaaaacgccaggccaccactttataaccactttctaaggagatgaacctgagtatcatggatactaacgtcaccagcgaacacctaccaaggggctggcacaaaaccttttataccctctggattggcagctttattaccgggatgggctattcgatgaccatgccctttatctccctgttcatcaacgaactgggacatttctcccgcctgcagctcaacctttattccggactcgcctttgcgatgacctttatttcccaggcaattgtttccccatattggggttcgttagccgatcgcaagggccgcaaactaatgtgcatgcgggcgtcgggtgtgatggcgatcaccatctttttaaccggtttgtcaaccaacgtttggatgatcatcgtcctgcgctttttacagggggccttttctggttacatcaacaacgccacggcgctgatggccggtgaaacaccccactctaagtccggttgggtaatggccgccatgatgacggccggggtgaccggtaatctcgttgggccgctgctcggggggaccctgtcgggatggtttggctaccgaatcccctttttcatcaccggttttttgatgctcgtcgtcttctttgcaacctggttcatcaccaaggaacagttcacccccatcactaagcaggccctcaagccaatgggcgaactgatgcacgaaatcccgaacgtgaagctgatcgtggtcatgtttatcaccaccatgatcgttcaatcctcggtgatgtcaatcgacccaattgtctccttgtacgtcaaggaactgatgcacaaccagggtaacattgccttcgtggccggggtggtggcggccaccccggggatggggaacttggtggccgcctccaaggtcggccacacgatggaccgcatcgggcccttgaaggtcctcatctggggacttttaatcgccaccctgctgttcgtgccaatgatctttactaagtccccgtggcacctggccttttggcgtttcttgttggggttagccaacgccgccctcttaccggcggcccaaacgatcctgaccctcgacgtcccccaagaagcctttgggcgggtcttctcgtacaaccagagcttccaagccgccggttccgtacttggttcggtcatgggttcaatgatttccggggtatattcttactcggcggtatttgccgttaccgggttcaccttactggttaacctagggctggtgctcctctttcggggtaagaaaaccaccccaactgattaaaatgacgaagctgagataggcgcggacttccctcagctttttaatttccgcaggctagacagaaaatacggaaaatcactttactttctttcccttcccggccttgaattgctataattactcttaacattgattaatttggaaaggatgatttttttaatccatggaaacagaaagcaccagccccgcaatattggtgatcattgtcgccatcctcgccttggcagcgttgttcacccttctcgaatactccctgattaaggttcggccaaccgaactgaggaccatgaagcagacccgcaaaattaagcgggtcttgcacatgttggatcacctaacggaatacctctccaccgcccaagttgggatcactttgacctccctgatcttagggtggatcggggaaggctacatcacggctttgatcatcaagtggcacctgttgccaaccgccgtggccaacgacctatcttcagtcatcgggatcttggtctttacctttcttcacgccgttttcaccgacctggtgccaaaaaacattgccattgacaaacccgtcaatattctcctggccatcgttcacccgatcatgttcttccacgttgtcttcttcccactggtgtggatctttgaccgctcagcagccgccattacgcgcttgctcggcttttcgattcaccccgatgaagacatctacacccaaaacgaaattgtctccctctcccaggaatctgagaaggccggcgaactcgaccgggccgacgttttattcatggaacgggcctttaagatgaacgacaaggtggccggcgacatcatggtcgaccggacccagttaacggtgatcgacgtcaccgaaacgatcgatgacgccgcccacctctactttgaaaagaagtacacccgcttcccggtcgtggccaatcacgataaggaccacatcttaggttacatcttctcttacgacatcatgcgccaaaaccagatcaacccggaagaatcaatccgggccatcgtgcggcgcttgccaatcgcctatgaaaatcagccgatcaccgacgttttacagataatgatcaaaaagcaggttccaatggtcattgtgcaagatgagtacgggggaacctctgggatcgtgaccgacaaggacatctacgaagaactcttcgggacgatcggcgaagaaatcgatcacgtccaagccgacatgatcgaaaagacccagcccgattcccaaggaaaccccacctttaaggtttccggaaaaatgccactggatgatttcatgcgctacttcaagatttccattccccagttcgaacagacccaagtgtcaactttgaccggctttttcctggagcaacagtacgacttgaaggtgggtcaaccaatccgggtggaaaacttctcctttacccccctcgacttggaaaacgcctacgtcaacgaatttcgggtaaccgttattaagaccaaagccaaggctaaggctactaagtcagctcaccagggcaaagcccccgtgccgaccagtagcggtgccaagggttaattaagctaagaaagtcgccgacgccgtgtgcgccggcggttttttatttccgaacaatcataatcgatcactatttattattcatcctttctttatttttacttgccagcgtgcccaattcatgacataatacttgcgatacgaaataaaggacgccagagagcgcccattttggaggaattgaatatggaacagacagggacacgccaagctaacaccatgaccactaacgaaaagtgggttatggcttcaacagcagctggtttttcgctcgagaacatggatatcatgtttctctcctttgccctcgccccgatcattgctagcctgcacatttccagtgcggcggcggggtggatcggctcaatcaccaacctcgggatgctcgcgggcggtgcggttttcggccttgtcggtgatcgcattggtcgtgtcaagacgttctcttacacgatctttatttttgccttcgccacggcagcgatgtttttcgcccactcactcccgatgatctacctactccgctttttggccggcatcggtgccggtggtgagtacggggtcggcatcgccctgatcgccgaaaacttctccacccaccaaattgggcggatgtcctcggtagccgccattggggggcaagtcggcgccatcttcgccgccttgatggctgcttggatcatcccgagcttcggttggaacgccctcttcttactcggaattatcccggtggtgttaacctacttcatccggcgccacgttcacgaatcggctagcttcttaacggcccaaaagcaagcccagcaaaaccacgaaaaggtcgctatttcccggctcttcgccaccccgcagttagcggttcaaaccctgggcctgatgatgatgacaatcgtacaaattgccggctacttcgggttgatgaactggctaccatcgatcgtgcaaaaacaacagggcttaaccgtctccggttcttcgctctggatgatcgccaccatcttagggatgagcatcggcatggtggcctttggaaccatcttcgaccggttgggcccccgggtcgccttcggaatcttcttattagggagtgcggccgtgatgttcgtcatcttggtggttaaatccgccaccgccctgatcctcgccggggccctgatcggcttcttttccaacgggatgtttggtggctacggcgccatgatttcccgcctttaccctaccgcgattcgctcgacggccaactcgatgattatgaacgtcggccgggcaattggtggtttctcctcggtcgtgatcgggattttgatggaccactacagcttagccgttacgatggcatgcttagccggactttacgtcgttagcttcctggtctcccaaaccctaccggggatccgtaaactacaacactaacattcgtgaatacagaaagaggccgggaaaaaatccgtttttcccggcctctttcagcttctcgaacattctattgacgctctggctgatgtccttatctagctggactagcaagtttgaccacctagccgttacatttcgcccccgttggccgctactaactggagaaacttttccaccaccggcgacaagatcgtgttcttgcgccaagcgagtaggtgcccactcgttttctggggtgaaaagggcacaaaggcgaggtcgtcgtctttgtacatttcgtaaacgccccggattcctaggtggtaatagtggtggttaaccaccaagtccctagagaccattggtaagttgatagtgatcagaatgttaagcttggtctgattgagcttcaaaacgtcgctaactgagtcgcgcatgatcccccgccgccccacaatcaatggcaggtcatacaaatcctccctggttaatacatcgcggcgggtcagcggatcatcttttttcatgataatcccccattcttcacgtaccggcaggcgcatgtaattgtacttagcggcttcgactggttccaccaaggcgacaatgtcttcagctccctgatctaagcgctcccggaggctgtcgccatcaccatcgaagagggcaaactgaacccccggataccggtcccggaacttggccaccattcccatcatgaaacctccaaccccggtttcgaccacaccgaggttaatcgtcccggttaaatcggttccctgctggtgaagctcattttccgcctgctccaacagggccaacatcatggaagcccgctggcgaaagagcacgccggcctggtttaagtgcatttgccgacgctgacggtcaaacaggggaacccctaattcctcttctaagtccatgatttggcgggaaagggtcggttgagtaacgtggagctgttcggccgcccgggtaatgttattggtctcggcgaccttcaaaaagtatcgtaatacacgcgtatccatgcttcacttcctaactagtttagttattcatcagggcacccttaattcgcggccagagtagttcggcaaggtgtcgtcccccggtaggactaaggtgaaggtggtcaccaaagtcattttccggggcgagcacggtggcgtgaggtgcggtcagctgtggcgcggtatcgactacccaaggttgactccccagccactgattaagggtgcgccgcttttggtccacctctttttcacccggttgaaagagggttggctcccctgccaagcgcaagggagcaagggtgggcacgatcaactcctgaccatgagccgccaacacactttttaagttggtgaaagcttggactaagctttcgacactcggaattggctcgtcccctcccggattatcgaccggcaagaggaggtcgttccccccaatcgaggcaaccgttaacttggccgatacggttaccaagtctgccaagcggtcaaccaaagcggggccaaaggttttctccggcaactgattggttggggccgcaagcgctagccggttgccggaaatccccgtcatccgccaagtaacggcattcgggaagtcacgttggctaagggtaaacaggcccgctgccaacatccccgtttcaaccagtgaatctccggttaggttgaccacggtcgctggttgggtcggttgggtctcgagcccggcgaatgagaaccagaacttacggacccgccagcggtcgtttagccgcggcaccttgccggcttgacgcgccaccccggcgttaacccaactcggttcaaaggtgcaagtgtaatcataataggtttgaggtcgctcggcaaccatcaacacgtacactggccgccccgcctcaacttgaaagtcaaccggtgtggtggcgagggtttgtcccggttgaatggtcaccgccccaacttccgtcgcccccgccatggtcggttgattagcaatggccacccgttcaaaagtcagcggcgcctttccataatgatttgtcatcattaagcgggttgtttccccactcaaaaaaggggtcaccttcacgagctgactcaactgtgggtagctaaaggggtaggcactaaaatcgtgcgggacttggtagtatgcgctttgccattccatcgttcttcctcctatgtacagataagggggaccaccaaggtggccccccttatcttattcttgcttggaaagtagttcaatcacttgggttgcatcttcaccagcgaagtacttattcaaatcaagctgctggagcttttctttgatcgctgatggcgtgtaggctaccccttggagggcttcttcaacttcgtgaacgtcaccggtaccaaagaagtcaccgtagatcttcaggttagcgatcttcccttcttcaactaggaagcgcgcatcaattgttccggagtcaaagtgccgccgcttttgaatggtaaagtccggggacttcccgtagacccaatcccagttcttgtaaagacgaccctcaatttcatcaattgcttggttatcttctgccgtcagttcgtactcgttaacctgggcatcctcaatcttatcgaccttccaaatccgcttgattaactcatcgcggaactgttgggtggttaagttttggaattccggcttcaagtaaggcatgatgttggttacccgtgagcgaactgacttaattccctttgattcaatcttgtcctttgggaccgacaaggcgtccgcaaccacatccgtattgacgttgtacatcagtgtgccgtggcagaaggttttaccaccacgggtgtacatggcgttaccagagaacttcttaccatcaatgacgatgtcgttacgccccgtcgccatcgctccggtggcccccatgtcgtggagggcgtccacaacgggttgcacgagttgcttgaagtcaccgaagcgaacttcatcggccgggacgataaaggagaagcacatgttccccatgtcttgatacatcgctccaccaccggagaggcggcgggtgatggtaactccgtgttcttcacaatattcctggttaatttcttccagggtattttggttgcgaccaacaatgatacatgagtcctcaatgtaaaagagcatgaacggaggagtcatttggtcactgttcatcaggtactgttcggttgctaagttgcgccgaatgtcgttcgacttcatcgctaggtattgcatcgtatctacttcctcacatatgaatcaattagatgttagttgggaagccaagggccacgtcagctgcgtccattacggcttcagacagggatgggtgtgggtggatcgtcagagcgatgtcttccacggtgctcccggattcgatggccagcgtcaattcactgatcatgtcggaggcactgtccccaataatttgggcacccacaattacgccgctgtcctttaaggaaaccaggcgaacgaaaccatcagttgccttcttagaagttgcccgcccgtttgcggagaatgggaacctggaagccttaacgtctaagccttgttcctttgcttgagcggccgttaaaccggtcgtcgcaatttcagggtccacgtaacatacggctggcattgcccggtagtcaaccactgaggattgcccggcaatcgcttcagcagcaatcttaccttcgtaggaagccttgtgtgccaaggcagccccggccacgatgtcaccaatggcaaagatatcttccttgttggtccgaccttgagcgtcaaccttgatcaggccgcggtcagtcgtttcaatcccaacttgttccagacccatgtccttggtgtttggcttccgaccaactgctacggcaacgtaatcagccttgatcgtgttcaccttaccgtcttgttcgtaggagacttcaacggcgtcgccagtatccttagcttccttagccatggccttagtaatgaccgtgacacccagttccttgaacttcttttcggtaatcttaactaagtccttttcgtaggcatttaagattgagtcggtcccttcgaggatcgtaacgtgagtcccgaagcgagcgtacgcgccggctaattcactaccgatgtaacccccaccgatgataaccagttcctttggtaattcctttaattccagaaccccagtggaatcgatcactcggccaccaaacttgaagccaggaatttcaatcgggtgagaaccagtcgcgataatcaggtgcttgaaggtgtaagtttgggcgttttcgccgtcaattacccgtaagctgtggtcggtctttaagaaggccaccccgtgaatcacatcaatcttgttcttcttgaagaggtaggaaaccccgttggtcatcttgttaacgacgcccgcacggaattcttgtaccttagcccagtctaacttaacgtcggatgcggaaattccttcgtcttcgttttcgagggccgtccggtagttttcagaaacttggatcagcgccttggacgggatacaaccaacgtttaagcagaccccacctaaagtgttttccttttcgatcacggccaccttttggcccagttcagcagcgtggatggctgccacgtacccaccagggccggaaccgatgacaatcgtgtctaaatcaattgcgtaatcaccaacaaccatgactaattatccctccattaacagtaattctgggtcaccaagcagttccttcatccggttcattgcccgttgagcggttgccccgtcgattacccggtggtcaacagtcagggaaagcttcagcaccttagctggttcgatgtggtcgtccacaacgatcggttcttgggagatcttccccatcccgatgatggcaacttctggccagttaacgattggcgtgaagtgacccccaccaatggaaccaatgttagtaatcgtcatcccagtgttgctcatgtcagcagcactgagcttgccgtccttagccttagcggtgttttcgctaatagcgtcagcaataccgaagaggctcaaacggtcagcgtgcttaacgttcggaacaaagagaccgttgtcggtgtcagtggcgatcccaacgttaatgtagtcacggtagttaatttgcttgttttccatgtcaaccttggagttgaagacagggaattcgcgcataatcactgctaaagccttggtcatgtaagccatgaaggtcaggtgagtcccgcggtcagcagccagttgcttgaacttcttgcggtggtcccaaagcttgtcaacaaccacgtcgtcaaagacagtgatcattgggatttggtccttagcagtcgtcattgccttagcagtggccttgcgaattttgctcatcttttcagcatgttctggccaaccttctgcggcagccggagctggggcagcagcaactggtgctggtgccggagcttcggtagcggctggggcttcagtagcagccggagcagcgccgttgaaggcgtcaacgtcagccttcaagatttgaccgtgacggccagtccccgtaacttggtgtaagtcaacgcccttttcacgagcgtacttacgaacggctggcatcgccagaaccggaacggagtggtctgcttcagcaggagcagcacccgcagcggctggagcggccggagcaggcgttgcagcaggtgcttcttcagcggccggagcttcagcggcaccgtcgtcttcaacgttaccttcaccgtcggcaacttcgatttcaaccagtgggtcaccgagttctgctgtttcgtcttcttgaactaaaatcttcgtaatcgtaccatcaaccggtgacggaagatcttctgaggacttgtcgttttcgatgttaaccaggtcagcatcctttgcgatgtggtcaccttccttaacgtgccactcgccgacagtcccttcgaccatcccttcaccaagttctggtaacttgaattggtatttactcatttcagatccacctcactagaaattaacggtcttcttaacagcggcgatgatgtcgtccttgtttggaagccaagcaccttcggcgtcactgcatgggtaaggggtatccggtgcggaaacacgggcaattggtgcttccagggaaaggattgcgtcttctgcaatcaaggcagcaacggagcccattacaccagcttgcttttgtgcttcttgaaccagaaccacacgaccggtcttcttaacttcgtttaagatcgtttcttcgtcaagtggggaaacagtacgaaggtcaagaacttcggcgttgatgccttccttagccaggtcttcagcggcgtttaagctttcgcgaaccatgtaaccgtaggaaatgatggtaacgtcagaaccttcacgcttaacggcagccttgtccaacggaacagtgtatgattcgtccggaacttcttgacggaaggaacggtaaacccgcatgtgttccaggaagaagactgggtcatcggaacgaatggaggaagcaaggagccccttagcgtcgtacgggtcagaaggaataactacccgcagaccaggaacttgggccactaacccttccaggttgtcggagtgcagttcgatggcgtgaacaccaccaccaaatggtgaacggatggtgatcggagacttacgagaacctgcgtgacggaagcgttgacgagccatttgaccagcaatttcgtcaaaggcttccatgatgaagcccatgaattggatttctggaactgggcgccaaccttgggtggcaagcccgttagctaaaccgatgatcccggattcagctaatggagtatcgaagacacgcttgtcgccgtacttagcttggaggccttcagtggcacggaaaaccccaccgttgttaccaacgtcttcaccaaagacaagaactttttcgtcacgagctaattcttcatcgagggcgtccgtgaccgccttaatcatcgtaatcttagccatgattatttggcctccttttctttgtactcatcgatttcacgttgaatagcacctggagtgtcgacaaattcgaacttcaagaagtcagatgccttttgagctggttggctttcaacttccttgatagcgtcgtcgatttccttagccacttcagcgttgtaggcttcttccttggcgtcgtcccaaagccccttgtcagtcaggaacttacgcatccgaaccagtgggtcctttgcgtgccattcgtcttcttcttccttggtccggtaacgggttgggtcgtcaccagaaagggtgtgtggtccgtaacggtaagtaagcgtttcgatgatcactggaccattaccttcaacggcgtagtcacgtgcttgcttagcagcagtataaaccgccagggcgtccatcccgtcaactacgatggaaggaattccggcagccacacccttttgagccagggttggagcagcagtttgcagcttccgtggaacggagatagcgtaaccgttgttttgaacaaagaagacagccggtgcttggtaagcccctgcgaagttaatcccttcgtagaagtcaccctgcgaagtaccaccgtcaccagtgtaggtgtaggcaaccttcttgtcgccgttgagcttgatcccaagagcaaccccagcagtttgagcgtattgagcaccaatgatgatttgtggtggcaaagcgttcaattcttctgggtagttgttagcgttgtagtgacccttagaccacatgaagcccttagctaaggacagaccgtgcttgatcaattgtgggacgtcacgatatgcacccaagaggaagtcgtccttggtcatcgcgaagttggaacccatttggctggcttcttccccggcagttggggcgaagaaacctaaccggccttgacggctaagcttagcagtttggtcaccaactaatcgggaccaaatcatttgcttaaacagatctaccaattgatcatcggttaggtctggcattaagtcctcattgacaaccttgccatcagtaccgaggacctgaagaacctcgtactcagggttgtgcttaaggctttcaaagtctaactttttcattatagtgccctccttaaagtaaaaaggataattaagttaccgcttacattgcctattatacacgcttttcatttatcgtaaacattgttcatcgttgagcgagcgatcgagaaagccgttacattaggctttaatccccatctgtgaaatcgtttaaaaatttttactaaaactcactgttttttaactattgattcgagtgaaaattgtccaattaattgctaataatcaaccattgctaagaatcaataatgcactttgggtattaactatccctctaagaaggtatttaacttttcaaattggcttctttataatggtattaacgatctggagaaaggatgatttaaatggctaaaaagcaaaccgctggccgcgaccagctgggggaattcgccccgaaattcgcggaattaaacgatgatgtcttattcgggcaggtttgggcccgggaaaaggaactttccttgcgggaccggtcctttctaacggtcaccgccttgatcaccaagggggcctttgaacagctcccctaccacatgcaaacggccaaggccaacggtattactaaagaagagattgccgaaatgattacccaactcgccttttacgttggttggccaaacgcttggtccgcttttaacattgccaaagaggtttggggcgactagtcttgttcattaataggtgcgcacccctacggccagtcttaaaggtgtggctgtggtggtcgattgccttagcttaatcagaaaacgcaaaaaagaggctgagagaaaaccgtgttttctcccagcctcttgctgtattcacgaatattagacagaaaatgtggaaaataaccgtaggtctagtgtctaagcaggccgaagaacggtgcgttccgcaccaactgttcgtccaatcttacatacgacctgccaaggaggttatttcccacccaccttgtcgtctaaaagacaaagttgaccattagaatgtaggcggtggtgccgataatcattgaagcaaacagggaccgccacttcaggtggactaaaatcgtaatcgtgcaagcaatcaaatccggccaaccatggttgccagacaaccaagtaacgttacgtaggcagtaaaccactagcattaccataatggcgccgggtaaaaactcccctagtccttggatatagcgtggcgtttgattgcctcgttgaaagaggcgaaagggcaccaccctagtcaagaagttagcactagcggcgaacgcgattgttaacaattgctgaactaaactcatttcatcgccctccgccggtacaaaatagtgaattcaacgactaatagtagcagggtcaccaagagaaagtaagttgaccccaccagcgttaagcaaaccaccgtaatcacgagacccgacaccgagctaacgtggctcttttctttgaggatctggtcgagagcgaggaccaaaaagagggcggtcatggtaaagtcgaggcccttaatttggatggccaaaatgctccccagggtgccacctaaccaggcaccaaacacccagtaaaagtaatcgagtgccgccaccatcgtatacacccgttggtgatccacgtcatcacccaaccgaagctggtagttaacgacaaaggtctcatcggttaaagaaaaaatctgaaagaacttttggaaaccgtgccccttgtacttacccaacatggcaattgagtagaaaaactggcgaaagcccaccaccagggtaatcaccaggacggtcagggggttaaaggcctgggttaacatgttggcgatcataaattcgaccgagccaccgtaaatcgttagcgccatcagggttggtacccaccaggaaaagccgaggttctgggtgtagagaccataccccaatcctaagacgatgtaaccgagcatcaccggggccgaagccgttagggcaatccgccattcgtgccgcctacttgaaacttgttcttccattaagtgatcattccttttgctcactcgttaagccgagccgtttttcaattagttgggccatctcacttggttccacccgctgttctgagcgttggtccccttcaaacagggccttgacccccgggcttaactcctcacctaagaattcgttgagtccttgaattgcttgcagcctgcgcgccgccgtttcctttcccgttaccgccgggtagaccgtttcggcaaacttgtaggggctagcggtggcgaccaccaccatcggggtgttatcccccgtccgttcttgatatcggtgcgccaccaccgaacccacggccgtgtgggggtcaatgacgtagtcagctgccaaatagatccgtcgaatctcttcgctaatttcttcttcactggcccaatcagcgacaaagtcttggtgcagacgctttaaaacttcgtcggtaacttgatattcgcccgtttggttcaattccttcattaaggaagccaccgcccctgcctcttggtcatacagatcaaacaagaggcgctctaagttactggaaactaggatgtccattgccggggccgtggtgaggtggaaggggcggcgccggtcatagtggccggtcgcaaaaaagtcggtcaggacccggttttggttggaggcgcacaggagcttgttgatcggcagccctaattttttagcgtagtaaccggcgaggatatccccaaagttcccagttggcacggcaaagttaaccggggcgccgagttcaacttccccgcgcttgaccaactggccataagcggtgaagtaataagtaagctggggaatcagccggccaatgttcatcgagttcgccgacgaaaagcggtcgcccgcctgggctaaccgagcggcaaattcttggtcgttaaagatctttttaacctcggtttgggcgtcatcgaaattgccggccaccgctacggccgccaggttatcccccttcatcgctagcatttgacgcagttggactgggctcaccccaccgtccgggtaaaaaacaactacttgggtcccggtaacgtcactaaagccccgcatcgccgccgagccagtgtcaccggaagtggccgtcaaaatgatgatttgtttatcatcaccggtcaccgtgaccgcctccttcatcaaccggggaagggcttgtaaggcaacgtccttaaaagccagcgttgggccgtggaagagttctaagtaataattccccgccacccgctcgcttaggggtgcaatctgggaatcatcccactgctcaccataggccccccggacaattgcttgacggctcgccagcgaaaagtcgtcaaaaaaccagccccaaatggtggtggcgacctcttgatagggggcgttaacgagggcccccaggtcgtagtctggttggggaaacgactggggcacaaagaggcccccgtccggggctaacccctgtaaaatcgcctcgggcgccgtcatttgcttggccgcttggtcgcgggtgcttcggtattgcatgtgatctccctcccgtataaaaaatgatctcataaattttttctattgtagcctaatttacgcccgtgttacaatcactaaaatgaaaaaaagattaaagagaggtggagttaatgagagaaatcaaagttggcttactggggctcggcacggtcgggtccggagtgttaaaaatgattcaagaaaacggggataaaattacgaacgtcaccggacagcggatcaccgtgaaaacggcgctggtccgtaatccggccaagcacgaggccgtggccgactcggttaccttaacgaccgacttcgccgagatcttaaatgacgaggaaatcgacatcgccgttgaattactgggcgggttgcacccggctgaagaatacatcaccgcccttttaaaacagcacaagcacgtcgttaccgccaacaaggatttaatcgccgccgttggtccccgcttggcccagttggctcacgataaccactgcgacctaatgtatgaggccagcgtggccggggggatcccaatcctgcgcacgattgccaatagtttttcggccgaccagatcttggaggtcaaggggatcgtcaacgggacgaccaactacatcctcacccaaatggctaagcaggggctcgattacgatactgccctcaaacaggcccaggagctcggctttgccgaggctgacccgaccaacgacgttaagggaaaggacgccgcctttaagatggtcatcttgagccactttgccttcggaaccgaggtcgccgtcgatgagttagaaatcgttgggatcgatcaattgaccaaagaagacgtcgcccaagcatcaaagctcggctatgttgtcaagctggttgggttagccaaggtggtcaaccacggtctcttcgtcgaggtggcgcccactttggtcaaccagtcccacccactggcttcaattaacaacgaaaacaacgccgtgatggtgacgggccaagcggtcggcgacaccctcttttacgggcccggtgccgggggcttacccaccgctaacagcgtcttgagcgacattacctccaccaccaaaaacctggtgttaaagacgactgggaactcctttaataacttcgcccaggagttaggccccgccgaccccaaggcggttagtttcccttactacctgtccttgaagatgccggacgtgccggggcaaatgcagcagctagccggcttgatgacccaggtgggcgctagcttccagcagctggtgcaaaccgccgcccaccaggggcacgcccacgtggtcgtgatcacccacgccattaaccaggcccaactggcccaacttaaggaactgcttgaccagtcaccaaccctgtccttacaggcggcctacaaggttttagattaggaggcggccatgcagattattgttcccgcatccagtgctaacttaggccctgggtttgattcaatcggcgtcgccctgtcgcttcttttaaccgtcgacgtcctcgggccggccactagctggcaagtcgaccaccaactggccgacttgccccacgacgagagtaacctgatcgttcaaaccgcccgtcagcttgtccccgacctcacaccacaccacctcgccgtgcaaagtgacatcccggtggcccacggcctgggttccagttccagtgcgatcgtcgccgggatcgagttggccaaccaactaggggcgttgcacctgtcaaacgaacaaaaggtggccttcgcctgccaactggaggggcaccccgacaacgtcgcccccaccatcttgggcggattggtgatcggcactgaagttaacggtgggtttgcggccgtcaaagcacccctaccgccctatttatttgccgcctacattcccgcctataacgttaagaccaaggaggcccgggccgccctaccaacgaccctccccttcaaggaggcggtggcggccagtgccacggccaacaccctcgtcgcggccctatttaccggtgactaccaactggtcgggcaactgatcgaacaggatcgcttccacgagcaagcccgggcccacctggtccccgagctaacccaactgcgggagctcggccaccggtgcggggccctggctacctacctcagcggggccgggccgaccgtgatgaccctgctcaaagaagccgacttccccgcctttcaggccgccattacccaggcgggcttgccgggacggctggttcccttaaccccccatccaacgggggtcaccgttagctaacgatccgaatgcaaaaaaggaggctgggagaaaaccgtgttttctcccagcctcctgctgtattcacaaatattagacagaaaatgtggcaaataaccgcaggcctagtgtctaagcaggccgaagaacggtgcgtgccgcaccaaccgttcgtcctagcttagtcatacgacctgccgaggaggttatttcccacccaccttttggattgtagtactaaggtcactgtgcctacccttgggttaataattcgtagacgtaggaattttcttccggccggtaaaccccaaataaggtccccacccgggtaaagccgttcttttcaatcaggtgctgcatcggcacgttgtcttcgtgggtatcgatccgcagcgacaggatgtctggccggttttgcttgatgtagtcaatcacgttgttaaacaaaccggacgcgtagcctttgccggcgtgagcggagtggatggcaacccggtggatcaccaggtactggtccgtgttgagctgccacttcccgtccatggcatcgtacacgggatccggggccggaacgattgaaaaggcgcccaccgtttcgtgatcgtcggagtgaactaggtaagcaacccccttgttgatgtcttcttcaacttgcttgggattagggtagtcgccttgccactggtcaattccccgttcggccagttggttgcggccgtcctttaaaatttcaatgacccggtcaaggtcgtccatcgttgccttcgtcaagtgcatgctggaaccttctttcattctaaattttaagataacgtctaccacattagcatatttgttaccgaaaattcaaaccaaacgattggcgccgcttacatgcctagcaagtcttgagggcttcttcgatcggtgtcgaaccgtttttaatgatgaagactttcttgacagtcgccggttcagccagagcggccacaatggtatgtgccacgtcggggattgcgttgctgtcactttgggcggggttaagttcaatcttccccgtccccggttcttccgttaagatcccagcctgaactagggtgtaatctaagcctgattcatcgaccagccacttgtcggcaaagtagcgggcgatgttgtaatcagtgatgtccctcaaggtctttaccttcccccacatcgcttggtccattgaataggccgaactgagcatgacgaagcgtttgatcccggctaagttggcggcctgcattaacttcaccgccccgttgaggtcaacctgtaaaagatttttcccccgcgagccggcggtaaagacgattgcgtccacgccggtcagcaacttggccatttggtcgggaagccaggtaaagtcaaatgcgaccggggtaatcaacttcccctttggtaagcgatcgagcttgcggccagcggctaagacttcttgaccagcagcggctagttgtttaacgacctcttggccaacccggccagttgctccagcgacaaaaattttactcattcaaatcaccctttctagttttatctatcttaccgccctttgcccaccgcttccaaacgaaagcccttgcgtccgcacacgcaagggcttaaggtgagagtatcaattctcaggaggttctcatggactcacaagcacaactaatggcaatcgccaagtttgccaaacaaaaactggggcaagataagagcggtcacggctttgaccacctaagccgggtggttaagatggcccaccggattgccaccgcaatggatcaggatccctttgttccggtggtggccgcctacttacacgacacgatcgatgacaagctagtcgataacgtcgacgccgctaaagaagaggtcgccacctttttgactgggctgggccttacagcagaccaggttgaactaatcatgtcgatcatcagccagatgtcatttgctagcaccttagacggtaaccgtcccgccctgcccctggccggccaaatcgttcaggacgccgactggctcgacgccatcggggcgatcgggatcacccgggcaatttattacggcggcaagcaccaccaagtcatttacgacccggccatgcccccgcgggaaaacctgactaaggacgaataccgtaacttggaccacgaaacgatcatcaaccacttccacgaaaaacttctcaagttagccgggatgctcaacaccccggtcgccaaagaaatcgctgcgcaccgccagcaagtgatgatcgactttttggctgagtttgatgccgagtggcaagcccaacgctagtctttgacgaagacgtactccgcttccgtcgaaaggtccgctcggtagcggtagccgccgaccgtgaaggccttaatggtggctaaggtaggttcattttctaaggctaggtatcggaccagcgacccccgggcctgcttagccgcggtcgcttgttgaaccaggcggccgtttttttcttgcttaaacaaaacggttacccaccggtcagcgggggtgaggtagggggtgatcgccttactgtattcctttgaggccaggttaaccactaggtcaccgctcgcaaagagtgcttggtaaaggcgggcgccccaatattggtagaggttcttggcaccggcaatttcgcccttagcccccatttcgagccggtagggcaagatgtcgtcgaaggcccctaagagcccgtacagcccggacaagatgtataagcgttgcccaaggttttgcaacccccggtcggtcaacactcccgcccctagtgattggtattgaattcccgcgtaagcaaagacagccggggtcccgacccgctttaaatcgaaggcctgcacccgggcgacgttttcccgggccagcttatcgctgcaccgccagagttcttgtaactcggcgggggtgcgcgactttaaatccgccatcaactccgtcacctgggcgggaaagcggatgggggttgggctaaccagtggttcgtcatcgctaaccatttgcttagccggtgagatgatcatcttcattttgctcctccgatctgaaaggtgggtgggaaataaccttctcggcaggtcgtatgactaagctaggatgaacggttggtgcggtacgcaccgttcttcggcctgcttggacactagacctgcggttatttgccacattttctgtctaacattcgtgaatacagcaagaggctgggaaaaacgtattttcccagcccccaatttgtcttttcactactgacgtaatgtgtgctccaccctaggcctaggccctacagagttagagcacgctccctatttcttctgttgcttgtctttatctgcactaaggttaatttccactgacccggtcggcttggtcggcccccccgagctcaagtgctcggtgaagtgacgtacccccaggccagccagggggacgatcgccgcgtacagcagggctgccaagaggacgggggccaaagcgatcttaccgaagccaaaggagaccgtccagttggccgtcaacaagtaggcgtacagcaccgtcaacaccagccgggtcagtaagtagaccaacccgacgattagacccagggtaatcccttggctggcgctcatgtgaatgtctaagggcatccgccaaccaaccacggcggcaatggctaaggcgaccactagcagggtcagggccaaaatccagtcggccgtttcggtcagcatcatgatcaaggcaccggcgactaggacgattccacccttgaacaggccaacgccgatcatcgccgccaaaccgaaggcacctcccacttcaatgatgccaatcgtccccattgggagggcgaagcgccattggacaagggagacgatcaccatcacgactaggcaggccaaagaaattaaccattcgcggacttcattggtcatgctaacggcttctttcgtgtatcttgcatccaggtgatggccaaggcgccctgaccaaggtgagtcccaatgacggggccaaagtagctcagctcaaaggacacgttggggtgatcttgttgcaacttagctagccactcttgacccgcctccttggcgttggcgtgaacgaccatcgcccggaccgggtagtcgagcttggcgatgtcttggtcaaagatctgttcgcaacgtaacttcgcctttttcatcgagcgcaccttttcaaaggcctcaattgcgtagttggcggtgtgcatcgtcaggaggggcttaatctttaaaatcgacccgacaaaggccgaggcgttggacaagcgccaaccccggaccaggttttgtaagtcatcaaccacgaagacgttgttgaaggtttcgcggtactcgcggagcttcttcgttacgtcgtctaagtcatcgccctgcttagctaacttagcggcttctagagctaggtagcccatcatccggatcgtcaggtgggagtcaaagggcacaatttgaatcgtgtccttcatctcttcggccagctgggtgaccgtattcattaagcccgaaatggcgctggttaagtgaatggaaatcaccgtgtcgtagccctggtcggccagggattggtacagctccatcagctcacccagcggtggctgggaggttgacggaaacgaggttgaggttgccagtttctggtaaaactcatcgttggtgatgtcaacgccctcacggtaactctgcccgtcaatgatcaagggaattggcaccacaaaaatattattcgccttgacctcttcttcagagaggtaagcggtgctgtcggtaacaacagcaattttcatggttgggtcctccatcgtcgtaaataaaattaattgaataattgcgggggatctgttcaatcccgtaaatatcaaaataccatagataccccctaaatacaattattgtggccccttaattcgcatttaggggacgagaaaggtatactattaaattagaagaatttgattcggaagcgaggaattttatatgtcatttgacggtcttttcacccacgccatggtgcacgaacttagtcaactacttaccgggggccggatcgcccggattaaccaaccctacccggccgaaatggtaatggtggtccgtgctaaccggaagaatcacccacttttgatctcggcgaaccccacctacccgcggctccaaattaccgccgttccctacaagaacccggcggtgccgtctaactttaccatgacgttgcgcaagtacttggaaggggcgctgatcgattcaatcagccaggtcgataacgaccggatcgttgagtttaccttcacgacccgcgacgaactcggtgacacccagcacctcaagttaatcgtcgaaatcatggcccgccacagcaacgtttccttggtcaaccaggaaaccggcaagatcatcgacacgattaagcacgtcggctccgaccaaaaccgggtccgcctcctcttgccgggggcgctcttccggatgccgcccaagcaagaacgcaccaacccctacctgcctaaccaacactaccccaagctctttagccagttccagggtgaccaggctggtttggccaaagctttgcagcaccaataccaaggctttggcaaggatagcgccgcggaattggcggccgaactgctggcggctgacaacctgccgacggcttacgagggcttcttgcgtcacttcgaacaccccgaaccagtcctgattgaagaccaacggggcaagcagcgctttgaagcctttccgccactcgacccgaccgggctcaccatcacccactttgccaccctgtccgagcttttggacggctactacgccgccaaggccgaacacgaccggaccaaggaactggccggtcaggtcttaaaggtcgttaacaacgagctcaaaaaggacaagcggaaggtcaagaagttaaaacaggaactggccgacgccgaaagtgccgacgactaccggatccgcggtgaactgctgaccacctacttagggcaactcaaggccgggatgaccgaaatcgaactgcccaacttctacgacgaaaaccggccgctccagatccaactggccccggaactgtcgccgtcgaaaaacgcccagcgctacttcacccgctacaacaagctcaaggccagtgtcgcttacgaccaggaacaactggccctggctaacgaagagatcaactactttgaaaacatcgtcagccagatcaacatcgcctcgccggccgacatccaagaaattcgcttggaacttgagcaacagggctacttgcgggtacggcgccaaaagggaaagaaacaacgcaaagtccaaccggctaagcccgagctcttccacaccagtgacggttccgaggtcctggtcggcaaaaacaacctgcaaaacgaccgattgagctttaaactcgccaacaaaaacgacctctggttccacgtcaaggacatcccgggttcccacgtcgtcttacgtaacccggcgcccagtgacgaaacgatcttagaagtcgcccagttggccgcctacttctccaagggccgcgactcggacaacgtgccggtcgactacctgccggtcaagcgcctccacaaaccaaacggcgccaagcccggcttcgtgaccttccgcggccaaaagacgatctcggtaacgccgaagcgactgcccaattaaaacctagtgaatttaacgaaagaggccgggaaaagctccgttttcccggcctcttactgtctgcccgaatgttggacagaaaatgtggtaaataaccgcaggcctagtgtctaagtacgggtgaagaacggtgcgttccgcaccaaccgttcgccctagcttagtcatacggcctgccaaggaggttatttaccacccaaacttttatattgggcagattgtaaaatttaagggctctttgtcaaatcctgttgatgggtcattttaggcggcggccggtgcttgcaccgggcgccgccttttttctgcttccgttcccatttgatgcaatcggatccgggcgatgaaatgaccaaagttagtaaagccatataccgtccgttgaattaacttgatcatgcggttgatcccctcaacccgaccgttggagtacggtaatacggttgcgttgtacactccttcgctgttcttacggagggtcttaagaactgtttggaacggcgctggcacgtcccatttggtgaacaagaggtccattaattggtcaacatcgtgctcttcaagagcggtcatggcgccctgtaagagttcataaccggccgctaactggggattaaggtccaagccaattcccacccgttcggccatcgttaccttttgtcgtaagtggcgatcatagtactccttagtgtagttaagcgatgtgcttttaagtaagtacagtcgccacgaattcttcaatgcccgatactcacgcgtattagggtcgaattgcttcattactgcgacccggacttggttaaacgcccgcgtaagcattgaaacgatgtggaatcgatccacaaccagctttgcgtttgggaagtagcggcgcacaaggccttgatagtaactgtttaagtctgtcgagaccgatttgactcgtttgcgctcttttagcgagaatcaatcaaagtaatgcgtaatactactcttaagccgatcagggagaatttggtagatttgtgaggtatcattatcaacgataatgaagcaatacttcccctgcggaccacggaactcaggttatgtccgtataattggtgtaaattctaaataggactttgtgaaatctgaaaggaacttcattatgccaaaagttgaattaaatttagaggatgacgaattaaaggagctattactaggtgatcgggataaggccatgcaatcaattatggccaagatccttgatgaaattcttaagtccgaagcgactgagcagattaaagctaaggcttatgaacgttcggatgagcgaaccaattcacggaatggttatcgggttcgtcagcttaccacacgagtaggaacacttgaactacacgttcctaaactccgtcatggcaatttttcaacacagctgttcaagcgctaccagcgtagtgagcaggcctttgatttggcattaatggaaatggtaatccaaggtgtttcaacacgtaaagtagctgagattactaagaagttatgtgggacaaccttttctaaaagtacggtctcggctttatgcaataatttggacgaccaagtgctggattttaaccgacgtccccttacgcaaaagtatgcttttgtgtatgccgatgcaattttatttaaggtacaccgtggtcacgttgtgacaagtaatagcttactcgttgcgattggaatcgaccctagcggtcgtcgagaagtgctcggttttgatatcggtgatagtgaatcaaaagctgcatggatggacttctttagtgaacttaaacagcggggccttaccaacgttgatatgtttgtttcagacgctcattgtggcttaaaggatgcaatcactacgcaatttcagggtagcctttggcagagatgtcaatttcattttagtaatgactgtacaagtattctggcactcaaggatcgtaaagaagttggcgaattgtagaatgaggttagccagtcattggcaaaataaaaaacgtcattgtgacgtatcgtgtatcattttaagtgactaaaccaaaatgaggagatacgtacaatgacgcacttaaatgatatcacgacagacactaatgtttctactagatctaaaggttctcacctgacgatcgatgatcgtgttaagatctctgtgcttaaagagcttgaatactctaaccgaatgattgcccagtatatagatgttgctcacgggaccattgatcgtgagattaagcgaggaatggtcaccaaaatgtccaaacagtcgaataacggtaaggtttactgctactacaaggagtactatgacccttatacggctcaagaacgttatgaaaaaagcaggtctaactgtggcagaacaccaatttatcaatcatctcctgaaatcattaatttgcttgatgatcttatgttgggcgaatttgactttaaggatcatgacaagtttgaatcattagattcgcaaaaatgctcaccttacgctgcgctcaagattgcagaatcgcttgttaatgacgacgtaaagcttcccgcatcggaaaggtccatttacaactggattgataagggactcctaagaacgaagaatattgaccttctagagaaaactcggcgtactaaggccaaacatggtcgaactccaaagcgtgaacagccaggtaagaacatttcccaacgaccaaaagaggtggaaactcgcaccactttcggtcattgggaaatggataccgttcaaggtaaaaagtcagctgaagatccagtaattctcgttctcgcagagagacttaccaggtataactttgcttttaagatcacatcaaaaacgcctaatgcggtttctagagttattaccaagctcaaagagcttacaggtgaatactttgacgagatctttaaaacaatcactccagacaatggtagtgagttctttgaggtcgctaatgaagttgaccaagtatactatgctgatgcttactcgccatggcaacgagggaccaacgagaacaacaatcggctccttcgtagaagtattactaaaggtaccagtttacaattgttcagtgaatttgacgttgaacaagcaaacctgaggctcaactcctacccaagaaagattcttggtggtaagtcttctctagacagatttgaagaggaaatacttaagatagttgaccctgaaacattagcagtataaacctcggccactcccgtggccgggtggctcacttaatcttgcaatttaggtcgtaaagaagttgctaaccgactcaaagatttatttaatgctccaacgtacgaccaagcggttgaacggcgtaaccaattggttaaagattggcagaccgagttccctaaggtggtgaagaaattagaaaatagttttgacgaattaatggtgatttaccagctcccagaggagctaaggaagcgtctccggacgaataatacaattgagcgggttaatcaagaaatccgtcgtcgtgaccgtgtaatccggatattcccgaatgatctaagcgtcttgcgactaatgggagcactactgattgaacagaatgaaaaatgggctgttggtccacggtacttaaacatgaccgtttaccacgggattgaaaaagatgacaattcagaagaagccggtatgcttaagcttgtgaaatgataaattcgcggaatttaatttacaccaacattttggacttgaccttgcttaatctacgtcactaaattcgttcaagttatttcttgcaatctgccatattaaaacaaataacccccgacatctatattatagatgttggggggttattttaacaatgatttgggagtgtaaaatattttgtgtaaattgataccttgagggtattgaaaaagggaaagccttccccgtatgattgaaatcgctaaaaaccaatcagaatacggaggctttccccatgaaccagtttaacaaagatattatcgcagcgctatcttccgacaaagatattaccctgaatgaagtcttacgtcgtcaaattgaagtggccgctaatcagttccttcaaaatgaactgactgcagtgctaggctacgaaccacatactcggatcgaccgatcaaaagacgacgtgaactaccggaacgggacgtacacccgcacgatcgacactgagtacggtgaaattaatctgacgatcccacgggaccggttaaacaagtttcaaaacgccctcttccctccttacgtgcgtcggactgatggactggaggaaatggtcatcaagatgtactccaagggcgtcacaactcgtgaaatcgctgatatggttgagagaatgtacggccactactactcaccaaccacggtttcaaacatcactaagcggacggaacacctggttgaagagttccacgagcgcaaattcaagtactcacagtacgtctgtgtgttcctcgatgctacttacattccgttacgccgtggtaccgttgaacgagaagccgttaacgtagcgatcggaattcgaagtgacggcggtaaggaagttcttgactacagtatcgcaccgaccgagaacggagccgcttggtctgaactactccagggattacgcgcacgggggattaaagatattcagttgtttatcgccgacggtttagttggacttcaatctgcgattgaggctaactacccgcaggcgaagtttcaacggtgctgggtccacgcagagcgcaaccttttagggtacgttcgcaaaaacgatcgcagggagattatcaccgactttaaggctattcggcaagcagagaacctacaagccgccaaagaacgattggcggctttcagtgctaagtgagagtccagttataagcgtcgaatcaagaaactagtccaaatggaggagctattcacgttcttcagttttccaactgcgatccgtcagaccatctactcgacgaacctaattgagtcgttcaataagggcctgaagaagatggtccgacgtaaagagcagttcccaaacgaaggagccctcgatcgctttatcatgacgcaagtgatggagtacaacgataaatttgagaatcgagcacattggggattcaaggactgtcacgacacgcttgattcgatgttttagaatcgccaattcatgcggacgaagtttccttttttacacaacattcttgacactctcaatgattttgaggggttatttgtaagaaatggaccctatttataattttgtacaagttcgaatagattatcttttattttgtttcgaacttttctaaaggcttgtagtttttctttttctgttccagtggcttttacagggtcgggtaatggccaatgaatacttgtagcttgtggtggaataactggacatttatctcgtacatcaccgcataaagtaacaattagattagctgaattgaagtaatttaaatcaatcagttttgaatactgctgactaatatcgacaccatcttctgccataacttgtactgcatttttgtttaaaccatgcttttctacgcccgcacttctaatttcaaatttatcggaaggaaaaagttcttttgcgtatccttcggccatttggcttcgacatgaattcccggtacagagaaaatagatttttttcatttggttactccttaatcataatattttcttttaatccatagtgctacatcaactaataagatcattaccggtacttcaaccattgggccaataacggcagcaaatgcttctccagaattcaagccaaatatagcgactgttactgcaacagctaattcaaagttattacttgcagcggtgaaagattgtgtcgcagaaattgaataactagttttagtctttttcgcaatccaaaaggttatgaagaacattaagacaaaatatagtaataaaggaacagcaattcttattgcgtccattggtagttgaactacttttgcacccttgacagaaaacatcactactactgtaaagagtaaagcccaagtagtaattctgcttatttttggtacatatttatcttcaaaccattctttaccctttgtgctaatgataaagtaacgagaaccaatgcccaaaatgaaaggtataccaagataaataaaaacacttttagcaatttcactcattgtaatattaattgtctgtgtttgtagcccaaaaaattttggtaagacactaataaagaagtatgcataaacggaatatagcaaaatctgaaaaattgagttaaaagctactagaccagcagcataatcgttattaccctgcgctaattcattccacacaataaccatagcaatacaccgtgctaaaccgatcatgattaaaccaatcatatagtttggataattgtgtagaaagataacagcaagagcaaacattaaaatagggccaacgatccaattttgaactaatgaaaaagcaagttcctttttgtccttaaatacatcacccattttgccataattaactttggttagtggtggatatagcattaatattaagcctattgctattggaattgatgttgtaccgatagaccaactattaattattttagggagcgatggaaaagctaaaccgctaataattcccagtgccatagctaaaaatacccataaggtcatataacggtccatgaatgataaatttttagaagtacgcataatagccctccatatagatatttatctatgtataatgcaaaataaaaaagctaacagtttgaatgtgaatccttacatatgcaatggtcagttttagatagtatttgtgttaattcactaatcagtccttcttttttgtttgaatttaaagaataatagtgccacttagtatcttttcttacgttaactaatccacttttttccagaatactcatatggtgggatagagtcggttgtgtaaagttaaagtgtgcaagtatatcacacccacacatctcaccacaggacagcatttctaaaatcttaagacggttaggttcagcaaccacctttaaaagtgatgccaaatctttatactcatagtgcatcagtaaattcctccacattaaacatagacgattatctatattgtatcacatgaataatgaaaaagattgccgttcggacgaaattagattttttactattatctgaaacttgaaagtatgaagacagactgatcccttggtatcacagggcatattttaattaatttaaccatttagcttgctgttaacagcgaaactaaccgtttcggcaaaaatgtgaagaactgattcatcatctgaataatttgggctcttcttgcataaacttcatgattaataatcgtttttaacgaatttagaagccataccagtgcttgagacaactcaatatctggcatggcttcgttcattataaagaataaatccccaatggtgcgatcatcctgattttgccgctcctgccaagctaataggtcataagtcatcatgacaattgctaaatggccacaaagcccgtcataattttgaacttgtgatttgtcgagccgcaagtattgcttggcaactttaaagtaattctcaatttgccatcttcgggcgtatagttgaatgatcgcttgtggctgaaggcctaactgagtcgttgccagtactaggtagtcatcttgacgggcccgattagccacaaataccaagcgaagcttgaatttttggttcccgacgtgcgcttcgacaaagcagctgtattgataagcttgcttgggttgatattttgaggcctgcagtcgcttgtataatgctttaactgaatattgccgtccgcgatattgatagtaaattttgctggaccgtttaagcatgcccacgccgtttaatcccaacttggttaattcatagaacatttttggtgagctataccagctatcaaataacacatagtcagctagaacgccatttgcgagggcttgcttgacaagttgcaatgaaacgaggttcattttttgctgtgcttggcgacgtctccggccagcaattgttcgttgatcggttgttttagctgattttccaaggacgttttgtggcttcttggaagacattaatgcaaagttgatcggtaagaatgtattggcgtcactccaacccaaagttaaagcccggtatcccttaatatataactgtttgtcatggtcaaagactcgcgctagtaattcggtttgggtggcgtactcacgggaaaagagtgtatcgtcaatgatcaatgctaaccgccgccggcggtcaataaacggtcgtaaatgcttgattaaatgactcccaacttgacaaatcaagcgttgccaattgatccggccatcgttcaaattatttctgacggtgcgactggtaaagttaggtatttcatgggctcgataaagcgagcgtcccaggaactttgtcgtgagcagccattcaatgaccttcatcaagctgatttctgaattccggcgataattcaccaacttggtgagtttagatagaccaatgagggaagtaaattgatgaacaatattgtgaagctcgttttctgtatttttttgtcttataatattcatgacgtaagtctcctttgtatcttggttttggtcgactaaagtatacaacgcaggagagcttgcgtttatttttttgccaaaaaagccaataaccacacgcctttggcgtgattattagctttcaagtttcagactattattacaaaaccagcagtattaatgtgttattcgccaaagccaaccatgtttttcttcatttgccgatttagctgttactttttgtggtaagtcaggttgtgtttgcttgtgagtagttaaatctaattgttgcgcctggtcagcaatcctatttgctgttgcaatctgttcatcttttacagttaattgccgccttaaattataagttaaaaacgacaataacaccaatcgacaagcaaagcttaaacttggttgtcgttcttgtcgttttttaaactaggggcgaattgtagaatgaggttagccagtcattggcaaaataaaaaacgtcattgtgacgtatcgtgtatcattttaagtggccaaaccaaaatgaggagatacgtacaatgacgcacttaaatgatatcacgacagacactaatgtttctactagatctaaaggttctcacctgacgatcgatgatcgtgttaagatctctgtacttaaagagcttgaatactctaaccgaatgattgcccagtatataggtgttgctcacgggaccattgatcgtgagattaagcgaggaatggtcaccaaaatgtccaaacagtcgaataacggtaaggtttactgctactacaaggagtactatgacccttatacggctcaagaacattgtgaaaaaaacaggcctaactgtggcagaacaccaatttatcaatcatctcctgaaatcattaatttgcttgatgatcttatgttgggcgaatttgactttaaggatcatgacaagtttgaatcattagattcgcaaaaatgctcaccttacgctacgctcaagattgcagaatcgcttgttaatgacgacgtaaagcttcccgcatcggaaaggcccatttacaactggattgataaaggactcctaagaacgaagaatattgaccttctagagaaaactcggcgtactaaggccaaacatggtcgaactccaaagcgtgaacagccaggtaagaacatttcccaacgaccaaaagaggtggaaactcacaccactttcggtcattgggaaatggataccgttcaaggtaaaaagtcagctgaagatccagtaattctcgttctcgcagagagacttaccaggtataaccttgcttttaagatcacatcaaaaacgcctaatgcggtttctagagttattaccaagctcaaagagcttacaggtgactactttgacgagatctttaaaacaatcactccagacaatggtagtgagttctttgaggtcgctaatgaagttgaccaagtatactatgctgatgcttactcgccatggcaacgagggaccaacgagaacaacaatcggctccttcgtagaagtatcactaaaggtaccagtttacaaaggtaccagtttacaaaggtaccagtttacaaaggtaccagtttacaaaggtaccagtttacaaaggtaccagtttacaattgttcagtgaatttgacgttggacaagcaaacctgaggctcaactcctacccaagaaagattcttggtggtaagtcttctctagacagatttgaagaggaaatacttaagataattgaccctgaaacattagcaatataaacctcggccactcccgtggccgggtggctcacttaatcttgcaatttaggaatgaagttcctttcagatttcacaaagtcctatttagaatttacaccaattatacggacataaccaagacaccaccgaccgaggagagcgaaataatgctgccaccgccattctcgcgtaacatggggataaactggcaggttaccagggtcgtccccaacaagagggtgtcgtaagcccgtcggatctggtcttccgttgatagctcgagtggtccaaacagggcgtagccagcgttgttaagtaagacatccacggtccaatattccatccggatcgcttcgtaagccttagcgatcgattggctgtcggtgacgtcgagttgaaaaagctttacgttcttcaacgccgttaattcggtttcctggggcgggttgcgcatggtggccgccacttgccagccctagttagcgaagtacttggcggtcgccttgccgatcccagacgaagcgccggtaatcacaattgttttcatgattgatgacctctttcccgttctactttgatcgttttgtaacttgttggctctagtgtacccccaccgccgttgcctgagaatttcagaaaggttatgatggtgttaagggaaaacgattggcaatgtacgttcaacaactagaaacctttatccgggtcgcagaggagggctcgtttggctgggcggcgaacaccctcttcatctcgacccccgccgtggtccagcaaatcagcctctttgaggagcactgcggggtgaccctgtttaagcgtagcaaccggggcgttcagttgaccccaactggccaagccctttacgaagacggcaaaaaaataatcgccctttccaatcaggcgttggcacgggcgcaacagattgaagaagacagcaaggaaaccctgcagattggcaccttcccgatttttcgggcccgggttttaattgatgcgatgacgatggccagagaagacgggctcccgcttaaatttgaaatcccgaacctagttgccgaactaagtcagatgaacaataattttgacctgctggggcaaaagtgcgacctgctggaggccatttattgcgacatcgcttggcaggggcagtgtcagttttacgaactcttccaaacgccccttggcgtggccgtcaaccaccaccaccccctggcggggcaaacctccgtcaccattaaggacctcgccccctataccattaccctttcgatcccgggcgtagcgagccaactggacgccttgcgaaccgacattctgcgtgaaatcccccacgccaccatccatgacgccgaaacgattggccaagacacgatcgccttaagcgaagtgcagccctacatcttcatcacccaaaaaattttccaggataaccaccccaacttggtaaccatccccttagaaacgccctacaccctgccctacggcctaatttattccaacaccccttcccaacccgtccgcgacttactcgcttacattgacgaccatcgagaagccctgatcaaaaagtgggtgtcgtaaggggccggtgcttagctaacactggacaagttaattttcttccggcctttcccaattccctagaaagcgattgtataacccgctataataagggtaattatttggaggtgtcttttcatggaatacatcaattaccagacccaggaccagtggcaaggtcccgctagccaacagtcacccatcgacatcgttttagagcaaactaccccacgccccctcgccgaccagcccttaaccgtctcctttgtcggcgaccaggcgctgacccgcgacccccgttcgtctggggaccagtttatcggcgctggcactttaacgctagggaaccaccactaccacttcttgcgcctccacttccacgaccacagcgagcacctgtttgatggccagcggcaagacgccgaggtccactttgtctaccaagacgaccaggggcaaaccctggtcttagccatgctggggataagggccgccgatggtgaagccggctttgacttcgctcccgtcattaacggtcaggccggtgccgcctacttaaaccagttctttgctaacaaccagggctactttaattacaccggttctttgacgaccccaccactgtcgccggacgtgacttgggtggtgcttgacgccgtgcaccccttttcttccggttcactggcactaattcacgacttgtttgccgacaactaccgggcaccacaacccatcacggtcccggtttaccattactacgagagtggaaaataaccttctcggcagatcgtatgactaagctaggacgaacggttggtgcggaacgcaccgttcttcggcctgcttagacactagacctgcggttatttaccacgttttctgtctaaccctcgtgaatacaacaaggggtcgggaaaaacagagtttttcccgaccccttttggtttggtaatgtgtgcgagagggttattgttcactccctttgttggcgcgttcaatctgcgccccgatcacggtggccggcgccgacttttggttggttaagtggtaatcggcgtaggggaagtgggcccggtagatggcgtcgtggtaggtggttccctcgtgactagccttgaccaaggcctggccggagaagcgcccaatcattaagcggacccaaatggcagtcaggttcattcccaagaccttggtcataaaggcgatgtctggggccgtcaggggtgagacgtcttcgtggaccccctcggcgtccccatcgacttggtagaggacctgatacaaaccgggcgtttcctgttggctaatcgcccgttcactggtggccgtcaccttggtggccaggtccgactctaagtgggccgggtaacgcttggccagggtttgatacttaccaactccctggtccttcagttcgccggtaacccccagttggtagactacctggccgtcaaagaggccgttaaactcgagggtcgggattgaggaaaccacgtttttggggatctgggtggcttcaatcaccaccaccttcgtcgtggggctgacccgctcaattgcccgccccagctcctgtttaccggcggggacgaaggcgtagtcaggccgctcgagccgggcgaccgaagcgaccgcctcttcggtcatcggctcgaggtaaaccttgtcgctcaaccactgggtcattaacaacgaattggggttattggagtggctaaccacctggtactggtggtgctttagttcgcgggcaatcatcgccaacacgtaatcgttagcggtactgttccccagcttgcggggaccatcgccaacgatcagggcccgggggccggcggtggcgtcgctctcgttttcggtttcaaaggtggcgtaaaagcggtgggggtgctcatcaaattcccccgccgaggggtccacctccttataaacgcggtggagctggttttcttcgcgcaggtccgccaccttttgcgggctgatcgcccaggactgggcaatttggtcgtcggacagcccccagtacttggcctcccgaaggatgtccagtgaaccctggttttcgtttaggcgccggaccaagtcggtcccccgcttgagctggtcgaagtagtagcggtcgatcttggtcaactcggtcaattcatccgaggaatacccgcgcgcgagggcttctaacagggtcagtaaacggtgcggccgggggtgaattagccgctcatccaagcggtcatcggagaaggtggcaattgctttgatgatttgctcgttggtcggtgtgtaataagcggcggcacccttaataatcgcctctaaaaaggaacggccgatcccgatcaccgaaccaaccgactgcttttccgtctgcaactcccagcgctgccctggcaggctttcaatcgggaaggtcggaaggcgaaccgccgtccggtccatcaccggttcggtcagggccaagtggcgcgagtagttgggccctaacttgatgttccgtaataactggccggcgtacaggtggccgcaaacggtcgccaccgggtacccggtcgccacctcgacaaagctagcgatccggtcgaagtaaggtgagtttttgatcacgtaaaagcgttgatgctcctggtcgagggcaaactgaacgtggttgaccccgacgatgcgcaggcgccgggtgatcgcaaaggcgacgttgcgaatgtcttggatttcccggtccatcaaagtttgggccggggtcacggcgacggaatcgccggcgtgaatcccaatcgggtccaggttttccaccatcgccaggtgcatcatcgtccccgaactatcgcgcatcaccaggacctcaatttcctttaagccggccagggattgttggaccatcacttggcccgctcgtgactcctggatcccggcggccacggcgttttgcaactcccggctgtcgtggacaatccggcgcggcgcctgctttttaggtagggccgcccgtacgatcaccgggtaaccaacctgggcgactaaatcggcggcgccctgaaaatcgctcaccgtccggatcagcttggttgaggcccccagctgcttgagggtctgggataagaggaccgggttgttgacctggcgaaccgttgcctcgggcaccccgcagtaatggatcccgcgttcctgaaaaatccccgtttcgctgaccgcctgcaccaactcaaaggagtggcgactccccagggtcgggatgatcatggtcggctcaaaccggttgatcaagtcgaccacctgcttaacccctaacggcgccaccaccgggtggtcaatcacccggtcgtcatcgagggcgtatgaaaaggggttgtcgctcaagaggattgtttctaagccgtgctttttgagggcactggcgacttccacggtggcttgatccagctcgctaccatgttgtaagtcgtcggcccccgaaccaatgattaatactgccgtcatcttaatcctcctctgtgccccgcgtcatttccatgaattcatcaaagagcgggtcggtttcatcagggcctggtgacccgtccgggaagaactggaccgaaaaggccggataacgccggtggcgcaggccctggactgcccccgtcagcatgtccacgtaggtcacaaacagtttctcgcggttgaccgactcgcgctgaatttgaaagccggccccctggttagcgtagaccacgtggtcggtgatgatttctttgatcgggtggttcataccgtgaatttccaccggtacccggtccacttgaaccccgttggccatcgcaaatagttcgtggcccagaccaattccaaacagcggtacccgttcctggagctcttggatcatcttgagcaccgattttttcaagctgtgcgggtcgcccggcccagacgacaagacgaccccgtccggatcgagccgcatgatctgatcgaccgtcgccgtgtagggcagcacggtgatgttacacttgcgtcgcgacagttcgcgcaggatcccgtttttaaggccaaagtcgaccaccacgatggaacggccgacccccgggttggggtagggcttgggggtggccacctgggccacttgttggctcgtcaacacggtggcgtgcagttggtcgaaggcgtgggcgtcggggactgggacgatcgacccccggacggcgcccccaatctcgcgcaacttacggatcaaggcccgggtatcgacgttggtgatcccgggcacgttgatcaaattgaggtactgatttaaggtcatccggtgacggcccttttgtgcggtgatgttagctaggtggcggacgatcacccccttgatcggcggttcgatcgattcatagacgttggagtggatcagggaattgccgacgttgggctgggtgaagatcacgatctggttgtggtagatcgggttagtgatgatttcttggtaccccgtcatcgcggtgttaaagaccacctcgccaaatgtaacggccggggcgccaaacccctctccctcaaacaccgtcccgtcctccaggattaaataccgctttaccatcaggatccctccctcatctcatcattttactatgcgtccgtgcgatctaagtaacttaacatttgttcaaagtaatccggcaagggggccgtgaaaaccatttcctcgcccgtgaccgggtgctcaaagcccagtaagcgggcgtgtaggtactgaccgtggcccggcaaggtcttgcggggcccgtacagggggtcgccggccagcgggtggttgatgtatttcatgtgcacccgaatttggtgggtccgcccggtttcgagccggcaggccaccagggtgtagtgctggtagcgcttgaggacccgaaagtgggtaacggcgtggcgcccgccaaccaccaccgcctgcttcttacggtccttgggcgagcgggccagcggggcgtcaatcgtcccctcgttttccttgatcaccccgtggaccagggcaacgtactcacgcagattactcttttccttgagctgggcggtcaggctgcggtgagcccggtcggtcttggcaaccatcaagagcccggaagtatccttatcaatccggtgaacgatgccgggccgcaactcgccgttgatcgacgataagggggcgtggtacatcagggcgttgaccagcgtgtggttggggtggccgggggccgggtgcaccaccatcccctggggcttattgacgacgaggacgtcatcgtcttcgtaaacaatgtcgagggggatgttttccggctccaggtcaatttcgaccggcgtttccggttcaatcaccacccgatcccccgcttggagttggtacttggctttgacggtttggccgttaacggtcacggtgccatcatcgatccagcgcttgagctgggagcgggagaactggggaaagtggtgacctaattccttgtcgatccgcccggtcatcccgtccgtgacggttaaagtttgcgttgtttggtccacgttagtcctcctttaaaatgatgatgattaaagcgatcaccccgacggtcaagcacgaatcggcgacgttaaagaccggaaagttaatcggtagtagttcaaacatgtcaaccacgtaatgctggtggacccgatcgatgaagttccccagcgccccggccatgatcaaggacagggcgatcattttccaccggttggtgcgccattgcctcatcaggtaagccagcaccactacggccgctaaggtaatcaggtaaaagaaccactgctgcccctctaaaatgctccaggccgccccgtcgttgtgcaggttggttaaattcattaggccgggaataaagccgtggctggtccccagggcgatgttagcgctgacccagtacttaacgaactgatccagaccaactaaggcaacgatgaacaaaagatagtaagccactaagcttcctcgctttccatttgcccctgggcggtcgcatcggttaagatggccctaagcgaagtgatcgagcggtggctaaaggtgaaggtcatcacctcgccgcgaaccgtgatcgacagggtgtggcgggtaaagcggggctggcgaatctcgtcaagcggcaccaccatgtactccttttgcaggatccggttgaagacgatctcgtcttttttgaccgtcatcgttcggcggaaaacggccagggccgccaccgcgaaaaaggccaccaaaaaggccgccgtgatccactgaaagtgggtaatttctagccagatcaccacgccgatgattaaaatgatgaaggtccatgaccacgaaatcaccgccgtggtcgggtcctgctggtaaaagtagcgtttttgttcttccaaagtcttctcttctttcatgtgaggtagtttatgattaaattatattccgacgccgccaccaagggtaatccggggcccactgggctgggctggctaattgtcgccggtggcaagcagcgccagcaatccgccaccctgaaccgggccgataaccaccacggtgaatttgccgccgccacggccgcctttgacgacctgttagccaactacggtcacgaccaagtggtgatgttttacaccgatagccgcctcttggccgacgcaatcggtaagggctacgccaagcattaccaatccgaactggatcaattgcttgagcggatcgacgccctgccaaccgtggtcacccagtgggtgtccgagagtcaaaatcacggcgcccattccttggccaaccaggctttgcagcgcttgttgaaaacggaacattaagcaggtctattataccaaattcacccggccacgggtggattctccagggatgtcagtagattttcaaaagtattttaacaatttgtcagcgcaccaaaaaaggctccccttcccgtagctatttcccgggaaatgggagcctaattttgttgtgattagtcgacaaccttaaagcggtctgcgtcgtccatgaattccttttcgccagctggggcttcgatcgagccgaacggcatttctgcccgcagacgccaggaagctgggacgccaaaggcttcgcgaatggcgtcgtcgatcagcgggttgtagtgttggaggctagcgccaaggccgttttcggctagggccgtccagacggcgaagttggcgttcccgatggcttgttcggaccagtcgtagaagttgtcagcgtaggacgggaattgttcctctaagttgtgcacgatgtccatgtcggtaaagtacagcacggtcccgtaagcggccttgaaggagtcaatcttagcgctcgtcttggcaaaggcgtcgtcatcttcaactaccttccgcagggcggcacgcacgatttcccacacttggtcgtgaccatcaccaaaggcaatcacggcgcgggtagtttgggagttgaaggcggacggtacggccttcatcgtttccttgatcaaagtggcaatttcgttgttgtcttggtccacctgcttgcccagggcgtaaatggagcggcgttgcttagctaaattcagtaattcttccttcatgtgtcaatctcctttttgctgttacattttttgatacatttactttacactactaactaaagataagcaactattttagctaactttttgaaagttagaatcatagcgccccgctttattaagcgtgttatcacatcaatcttgttctttcaacgaaaaaaggggttgagagaaccgtgcgttttctcccacccctgatgttatttactggagaacgtggtcgctattctcccttatacttgcttgagatcttgaagtacttgaggttcttgacgtttggcttcttggtaacgtcggcgccgtagaacttcttggccaacttggtcagggtgccgtccttctttaacttggctagctcctcgttaacttccttttggagggccttgtcctttttattgatgacaatcccttcacccttaccgtcttcgttggtcacgaagtacatgtccggatcgatttccagcccggagttcgggtaggcggctaaggctagcttttgcaggtagtagtcgttcatgatcaagtcggtcttgccactttggacgccctttaagtagacgtcgttggagacgttgtcgtaattaaccaacttcgcccctaattgttgggccaggcgttggtagttagtcccggcttccccagccgcctttttccccttgatgtcggcccaggagtggatcccggattgatcgtctttacggaccaacagcgagttaaagctgtgcttgatcggcgaagacattaggaactggtttttgcgttccggggagatggcaaagtcgttaaccgccatttgggccttgccggtcttgacggcggttaattgaccatcaacgttgtattccttaaagaccaccttcttgtggagccccttggcaacggcacggatgacctcgatgtcgtaaccggtcaacttcttggttttggggtcgtggtaggaagttgggtacaaggttcccgacgtggccaccgtccaggtcttttggtcggcaaccttttgatcctggctcttaccgcaggcggtcaggccgaccccgaccagggcaactaaactcaaaccgattaatttctttaacttagagttcattttttaacctcgtgtagattactttaaataactgctaatcacaagatagcaccggtaaagcggtttcacaaggcgaaattcacaaaataatcaaaaataagaaaagcctgggacgcaaaaggcgccaaaccgggcttataacgggttaatcgaattcgtacttttttggctctacactaaatcttgttgatggattaccatagtggtgattcgttgacaggattttttggttttgagggcgacgaattgtcaaatcaagcgcaactttgtcccgaagaaaacttcaaatggactcttccagcctaagaccttacgtggtcggtgatttaaatccctgacaaacttgtcgatatcttgatcagttagttggtctaggtcggttcctttggggaaatactcacggataagcccgttggtattctcattggttccccgttgttggggcgcatggggatcgggaaaatagactggaatgcttagttcttggctaacttcacggtatcctgcgaattcagttccacggtccggcgtaagcgtccgaacgcgtttaggcgttacggtatgcaggaggtcaatcatcgcttgtgtgacgttcttggcgtttactttgagaacgcgctgagataataaataccgagatttacggtccactaaggttaccagggctgaacgcccggttttaccgcgaattgtatcaccttcccaatgaccaaaccggcttcgattctcacatgaaaccgggcgttcatgaacggaagggacgtcgttaaatcgtcctcgacgttccttaatggttcccttggcctttcgggttttaccacggtgacggagcttacgggcaaagccacgagccccgtgactcttacgtttgatgcctaaattatcgcgttcaatcccacgataaatggtgttataactgatacgccattcgctgttttcgtgggctaaacgacctgaaatctgttccggggaccactgacgttgaacaatacagtgaaggataaaatcccgtaacttcaagttagttagaagcctaggacgtcggctttttagtcgacgtccctgatagttctcttgggccttgacggctgagtaagccttacgaccgccattgcgtttgatctcgcgcgatacggtggctttagaacacccaatcctctgcgcaataacttgataggtgtccttcaaagtgacgcctaatagtatgcattctcggtcttttaaggtaagatggttgtacgaactcatagcctaagatctcctttagatgtttgttgtggtaacttcattttacaggactcaggctatgagttcttttttattttcttcttacttgttgcacttcaattgtaaattcgtcgcacaaaaaaaggccccaccagccttaaaattctgatcattaactaccacgcaaattccagaaagtaagaggtgtgaccttatgactgattatattaaaaatatccttcaaattaaagaccccaatcttcatttcacagacgttgtctttgaaaataatgacggatgggagacgcaggtcttcattgggacggtctcgcttaaattggattggtgcccacattgcggctttgcggataccttcattaagaatggccattcttaccaaaccattaagtacctctcaattaacgaaagttgtcccactatgttgcggatcggtaagcaacgcctgagatgtaagaattgccaagattcgttcatggcgaagaccaacgtcgttgataaatactgttccattgccaaagcagttaaacacaaggcacttacgatgcttgaaagtaatgtctctcaaaaggacgtgtctaagtttaccggtgtgtcacctagtaccattggccgactcctagacagtgatcaagcgctccttcgctttaatagtcgcactttacccactaatattgccattgatgagttccgtggtccgcaggggaagtattgcttcattatcgttgataatgatacctcacaaatctaccaaattctccctgatcggcttaagagtagtatcacgcattactttgatcgattctcgctaaaagagcgcaaacgagtcaaatcagtctcgacagacttaaacagttactatcaaggccttgtacgccgctacttcccaaacgcaaagctggttgtggatcgattccacatcgtttcaatgcttacgcgggcgtttaaccaagtccgggtcgcagtaatgaagcaattcgaccctaatacgcgtgagtatcgggcattgaagaattcgtggcgactgtacttacttaaaagcacatcgcttaactacactaaggagtactatgatcgccacttacgacaaaaggtaacgatggccgaacgggtgggaattggcctggaccttgatccccagttagcggccggttatgaactcttacagggcgccatgaccgctcttgaagagcacgatgttgaccaattaatggacctcttgttcaccaaatgggacgtgccagcgccgttccaaacggttcttaagaccctccgtaagaacagcgaaggagtgtacaacgcaaccgtattaccgtactcaaacggtcgggttgaggggatcaaccgcatgatcaagttaattcaacggacggcatatggctttactaactttggtcatttcattgcccggatccgattgcatcaaatgggaacggaagctgaaaaaaggcggcgccaggtgtaagcaccggccgccgcctaaaatgacccaccaacaggatttgacaaagagccattaaaacccggtaactcgcaaaactggttgcgaattaccgggttttattggtttataaagatctctttttgacgattacacagataacgtgctcccaaccacaggcctagtgcctaagtctggtcgcagaacaccgctggcgcgctaacctgcgccctatccttagtcatacggcctgccgaggaggttggggcgcactcacttctctctacctaatcttcttaccccagtactggaacaggtcggtccgcaaggccccgttatagagcttgcgtttcttcgtggccggcgccccgtagaacttttcaaactccaggtcggcggtcaagatgtacttagaccaggtggtcagcggccggtagagttcccccatctggcggtaaagctcgcgtaccgactcctggtcagacaagcgctccccgtacggcgggttggcgacgatgaccccgttaatttggtcggtgtgccagtccttaacggctagttgcttgaaggtgatttcctggctcaaaccggccgcccgggcgtttttcttggcgatgtcgatcatgttttggtcgatgtcgtagccgtggatgtccaattcgacgtcgtaatcggcggcgtcttcagcggcatcgcgcaccgcatccgataagccctccggcaccaagttaacccagctctcgcaagcaaagtcgcggttgagccccggggcaatgttgtgggctaacagggccgcttcaatcgggatcgtccccgacccgcaaaccgggtccacgaaggggttgtccgggaaccagtgggccaacatgaccaaggcggcggccatgttttccttaagtggggcgccccccttggccttgcggtagccccgcttgaacagggagctgccggtcgtgtccaggaggatcatcacgtggtccttattgatgaccacttctaaggggtagcggctcccggtttcggccaaccgggtccgccggtggtaaacctgggagagcttttcgacaatcgcctttttgacgatcgcctgggcggacgggacgttgtggagcttagagttgcggctccgcccctcgaccgggaagttggcgtctaggggcaacaggtcctcccaggccagggccttggtgccttcaaacaggtcgtcaaaggtgtaggcgtcaaactcgccgaccacgattttgatccggtcggcgcagcgcagccacaggttggtcttgatgacgtcttcgatcgttccctcaaagcgcacccggccgttttcgacttgtccctggtaacccaggtcccgcagttccctgccgaccagggcctcgatgccggccgcggcggtcgccagcagttgatatttttgcacgttaattacctcgtttttcagtctgccttttatcttaccacactattgggccagggtcgctaccaccagttgccacattttggcgtgctgttggttaaaaaagtggggcgcctcggtgggggcgaagaacttagtggttaaggtttcgcttggtttgggcgtttgttgacggtcgtgcaccctttcaactaggtaaaaagcgttgaccggttggaccgcatccccgttcgggtaggtgtaaaagtcgtcgtcttggattgccagcaacttaaccggagtcacggcgatgccagcgtcctctaaaaactcccgcacgacggtttgcttgaaggtatcgccgtactccatgtagccgccgggaaatccccagtcgcccgtatcggcccgctcctgcaagaggatccggccgtcttcgaccagggcgcccgaagcgctagtcatgatcaggggggtgtggcccaccttttggcgtaggtcgtgaatgtatgccattgtctactcctttccccaccagtccggtaggttaacttgtccttcggcaacttcctggccgtcttggtaaaccaggacctgtccggtggccagctgctcttggctgcttcctaggcccagggcggtttgctcttccggggtcgtcaggcggtggaccaagacgttggggaactgggagcgcaactcggccggtaagtcgagcggtgactgggtggtcatgatcatggataaccccagtttgcgcccctcgcgcaggacctggaagatcccgttacgggctagggccgccccgttgcttggcaagtagcggtgagcctcgtcaatcaccagcttgaccgcaaactgccccggcttagctaaccggaaggccaacagccgctccaagaggaccgagattaccgtcgtttgcccctggccgtaccgcttgagggccgccaggtcgagcaccagggtcttgtggttgctacgctgggtcatgaatattttcaagacgaagttgagctcggtttgaacggcgccgggggtgggaaccgtgccaaagagggttcgcatcgccggggcgttaaggcgctcacgcagggccaacagctggtcccagtgggcgttcagcgccgcccggtcgtactcctggccgaggagccggtagtcggcccgctcgtctgggtaggggtgcaccgtttcttcaaccacctgatcgaccaggcaaccgaggtcgtaatcgctggtccactcccccaacctagccacctggtcttcaaactcactcgccaggcgcccccgcttttggtagacgccgggggtggcgagcaggttcttttggatccgtagcgcggtgattgcggcttcgagcttggtcaccaaccacgggtccgccggtagttccagcacccgcaataactgcggcgccgttaaggccccggcctccaagtaggcgttaacccccagccggtaggtgatcgtgttggggagcttggcgtactcgccggtcgggtccaggatgatcgccgtctggctggtttgttgcaattgcgacaagagggccagggtggtggttgtcttgccactgccggtctggcccaccaccagcaggtgccgcttcgtcagctcggtagcggtgacccgccccccggtttgttccgtcattaattccgtcatagtcttcccccgttctatcattttccccattgtagcaccccagccgggccacgcaagtaaccttattattaacattttaattaaaatctaattggattattattccccggcctgaaaatcaagagggcccacccctactaccgcggctgggccgtcgtctggtagggcacgtgcatcgtttgggggacctgatcccaggcgaccgggtaaccagccccgtgggcgcaaaagaccgagtccggcgtgttagccaagtcgcccaccggatcgtaattggcagcctcgatcagtggggttgggtccgctaccggtcggctacctgccggggtcagggttaattgcccctggccgtgggtgtaggcccgcaccgtcgccgcgtaatcgcgcaacttagcgaccgggccactcccctccaagcgcaccaagtcgccaggcccggcttggggttggctaacttcaccgccaaagcgttgcaggtccgtcaaagcgtggccgactgcctcggtggggaccagtaactgaaagttataccagggttctagcagttggttgcccgcccggccagcttccattagcccctggcgcagggcccgccaagccgcctggcggaagtcgccgccgacggtgtgaacgatgctgcccttaccaccgaccaaggtaaccttgacgtcggttagcggggcgccgactaggatcccccggtgggccctttgcttgagggcggtcaaaatttggccctgccaggcgtttgataagacgtcgacgtggcactggctggcgaaggtcaagccactcccacgggctcccggttcaagcaagaggtgaacctcggcgtaatggcgcaggggttcgaagtggccgaccccttctatcggggtggtcagggtttcttggtagcggatccgcccctcgtcaaagcccaccgttaggccaaattcctcttctaagcgctgggtcaggatttctagttggacctcccccatcacctggacgtaaaggcgctgggtcgccgggtcgtccacgacgcccaacagtggttcctcgtcttccaattgacggagggcggctaaacattggtcaaagggcgctccccgttgatccaacccgtaggtcaagaccggccgaaagcggggctgggcctgctcttcaaccgccccgattccctggcccggcacggtgctagtgggccccgccaccgtacaaacctgccctgggccgacctcctgcaccacggtggccttagcgccattgtagacccggagctgatcggccttttgccccggcagcaactccgctttggcccgcaagttgccgccggtcacccgcaaccaggtgagccggttgccccgctcgtcgtgggaaaccttaaaaacccgggcgccaaaatcgggcgtcggggtgggcgtttgagtccactccgttaaccccttaatcaggtccgccactccctcgtccttgagggcggcgccaaagtaaaccgggaaggcgcgccggtttttgatcaagctccggagctgggcgggagtgatttcaccgttcgtcagataatcgtccatcaccccttcatccaggagggcgagctcctcgaactgggcagcggggtctttaaagggcaggcaaccggggtctaactcgtcttgtaactgcgctaagaccgccgcctggtccaccccgggggcgtccatcttattgacgaaaacgaaggtcggcacctggtacttgtccaggaggtcccacaggatccgggtcgttgcttgcaccccggcgggagcggacaccaccaggatggcgtaatcgagcaccgctaaaacccgctcggtggccgccaagaaatcgatgtgaccgggcgtatctaggagggtgagttttaagtcaccaaagctgagctcggcctggtgggggaagatcgtgatcccccgctgttgttctaattgatcggggtccaaaaaggccgaccccttatcgacccggcccagttgacgggtgaccccggcgtggtacaagagggcttcggatagggtcgtcttcccggcgtcaacgtgggcgaccagcccggtgacgatttgtgacatgatgctaccgcctttctatagtaagtgagtgcgacccaaccgttaagcaggccgtgggctaagctagggcgggggttagtgcggaacgcaccgttctttgcccgtacttagccactaggctcgtggctaggagcacgttatctgtgagtgtgacccaaccgttaaacaggccgtggactaagctggggtgaaggttagcgccccttttctatgtggcgaattgtcaaactaagtgcaacggtttgtcaaaaaatacttcatatggggtttcatagtttaacactttgcgaggacgttgatttaactgcttttggcagtgttcaacgtcctgttctgtataattatcaatatctgttcgcttgggaaaatattcccggattaatccatttgtattctcatttgttccacgctgttcaggcgaatatggatcgggccaatagacagtaatacctaacctttcgctgatttcatcaagatgaagaaattcggtcccatgatctggtgtaatagaatgaacaaattctttaggaatggcccctaacagttcaactaagcctttatttatctcctgcgagtccttttgcataacctttttgataagcgtaagccgactaagccgatcgacaaccgttaaaaggatggagtgacccgttcgaccaatcacagtatcaatttcccagtcacctatacgttgacgctggttgataaaaccagggcgctcatggatcgagatatagtcggtctgtacttctcgatgtcgtctagtattctttgaatgccgggtccgatgtttatgtctgagatggcgctgaataccggtatcaccacgtgaggagtacttttcacctaaattgtgttgatagatatgacggtaaattgtgttgtagctaacacaccattgatgttccttattaaagcgagcggtaatctgctctggtgaccagtgcagatctaagatgtaatgaacaatttgacggcgtaattgtggatggctgtctaatagccgcttcttgtgacaattctgccgcttttgatgatagtcattatctgctttgcttggggaataattacctgcacaacgttttaactcccgtgaaatagtgcttggatttcgccccagccgtaacgcgacagcccggatagataaccccttagctcgtaaaaacataagtatttcacgttcttttatagtaagatgtttatagctcataccggatacctcgaattgtttaatttggtcgttaaacatattctacccggtatgggtttatttttttactttgtgttgcatttcaattgtaaattcgccgtacaaaaaaacccgggataaatcccgggtgcctggatgcagacttctgtaggccatgttttgtcaaagtccggtcctcaggcaagaccgaaccgtggtaatcatctatctcagcgcaagatgcgctcccctggaatcgcttcaattcgctatccaaagctcccctaccgtagtttgggtttaccgcttgaggggtttaccgcgttccaccgttaaggtttcccttaacgcttcgtcactgtggcacttttcaggaatactgaggcatagtaaaaccgtagcccgtttttccgccgtcaccgggcaagccggtgccccgccttattttttcagcgagcacaaacactacgggcatcgcagcccgtgcgagcatggaccttcctaacacgaccgttgccgtgctcaattacccaaagcctgcatcgaaaacctgtggtcaattatagcaagtgagaatcgttttcgtcgttacccagttgggaaccaaagacgcgccgttccaggttggacagccgctttaagatatccatgttggtagctgacgaaaccggttggctcgccgccgaccgggaactaatggaagaaccgacttcgacttggcggtttaattcgtccaccttggccttcaaacgatcattttcgtcttgcagccgggttacttccttgttgaaggcatcgtaatccttaataacatcgtctaagaaggaatctacgtcatcgacatcgtaccccttcccgatactcttctccttaaactgcttgtgcagaatgtcttggggagtgaatttaatgttatccaatctcaacacctcatctcactaagtaatgactggttaatactttattattctaccaaaatctgtctaaaactcaagggtaacttttcatcttgaccatttcttaatgatcagtccgtcatttccccctcgttttgctcggccgcccactcgttggccgcctcctccaaggctggcatatcaattaagtcaacttggtagtcgggaaagtcctcttggtagcgcttggccgcgcggtataaccagtagggcttgctcttttggtccgggttgttttcctggtcgggatcgtaaaccaagaggagccggtcggtgtgctcaaacatgaagcgctggtacatccgtagctgctcgggtgactggtagggttggggggagacctcggcactaaagtcgacgttcgcctttaagctggctaactgggcctggttggcctcgttccaccggttggcaaagtcggcgaagggcaacatcatggcgacctttaaacgggggtaatcttcctttaaggacagccccgcttcggccgaccactgttccacccccagctgggggccggtaattagccagctttcttcctcgttttggttcagccactgggtcaaaaactcttttaacacccgttcaatgaccgttttcttggggtctttggggtcaaagacgactaattcaaaggcccggtaaccactcacccaaattcgttgcataaaaaaactcccccatctttaagttgacaaagattgctagaccgctttctctggtataatgtaacacgtgtagttaaggaggtaaatcgagatgacgatcagataccccagtgggcaacaaccgccaaacgctggtcgggcggggcagccaatcgtggcgccccactcctcgagttttgccaagcgggggatgtccctggaaaaagaaatcaacgacgctaaccgttattacctggccactgagcaggcggtgatctacaaaaagccgaccccgatccaactggtgaaggtcgactaccccaagcgcagtgccgccgtggtcaaggaggcctacttcaagcgcccctcgaccactgattataacggtgtctaccagggttactacgtcgattttgacgccaaggagacccgggggaaactttcttttccacttaagaacttccaccaacaccaggttgaccactttcggcggtgcctggcccaggggggcgtctgttttgccttcatccgttttaccacccttgacctaacttacctactccctgcctccgacctgatcgcattttgggatcagcaaggacggggcgggcgtaagtcagtccccttaaccaccattaaagatcgcggctttcgggtcaagaccgggctcaacccggtgctggattacctgccagctcttgaccaactgatcgccgcaaaccaagctaaaggagcagatcatgaataatgaagaagtttctcggcgaagccaacgcccccacaaggatcgcggcggccggggacggggctcgattctaaaacgaatcttcttgtgggcccttagtctcttcgtcctcgccttcgtggcactggcggccctgtttttctactacgcctccagcgcccccacgatcaccgaaaacgacctcaagagtcaaaccaccaccacgatttacgatgccaacaacaaggtcatctcgcggttgggggcccagaagcgtgaatacgcctcgaactcggagattccaaccctcttaaagcacggggtcgttgccatcgaagaccgccgcttttaccaaggccacggggtggacccggtccggatcgtggaagcggcgatcgacaacgtcttacaccgttcgaacgggatgcaaggggggtccacgattacccagcagttagtcaagttgtcggtcttttcgacggccgcttcggaccaaaccttcaagcgcaaggcccaagaagcctggctggccatcaacgtggaacgccacttcaccaaaaaccagatcctcgacttttacatcaataaggtctacatggggaacggggtttacgggatgaagacggccgcccagtactactacggtaagaacctaaaggaattggacctctcccaactggccctgttagccgggattccgcagtcaccaacctactacaacccggccaacaccgatactaagccggccacccagcggcgcaacgaggtcttggccgccatggtccgggctaagtacattacccaggcccaggccaacgccgccatgaaggaaagcgtcaccgacgggctcgattccacccacggtaacaccagttccaacgattctagcgttgacgaaaaggtggtggactcctatgtcaaggaagtcctgacccagctggaagccaagggctacaacccgaacactgacggcttgcaagtgcacacctccttagacttgggggcccaagaagaactgtacaacgccgctaacaacacggtttccttccaaagcgataagatgcagaccggggtcgccgtcgtcaacccgcacaacggtcaagtggtcgccatgcttgggggccgcaagaccggggacgtggtgtacgggcttaaccgggccgtgcaaaccgaccgttcctccgggtcaacggccaagccgatcatggactacgggccggccatccagtacctgaagtggccaacctactacgccctgtccgacaccaagttcaccttcccgggcaccaacaccgtcttgcacgactttgataaccagtacaagggcacgatgacgatgcggaccgccctggttgaatcacggaacgtgccggccgtccggaccctgcaagccgtggggatttcccgggccactaagttcttaaagggcttagggatctcacaaaagtcggcctacaccctggctaacgggatcggcctctacgtctccccactgcaaatcgccgcttcttacgccgcctttgccaacgggggaacttactacaagccgtactacatcacttccattaccactcaggatggcaacaccatcaactacaacaagagcggtaaaacggcgatgaataaggcgacggcttacatgatcaccgacatgctcaaaggggtcatcaactcttccgatggttccggaacggccgccaagctctccggggttaaccaagccggtaagaccgggacgacctcggcatactcagcagccaccggaacaacttccaacaccaactccggggtcatggactcttggatggctggttacaccaagaactactcaattgcggtttggactggttttgacaacgccaagacctcgatttcctcctcgtacaccaaggcggctcagtacctctaccgggacgtcatgcagtacctggacgccgaaaaccacgccagcgattggacgatgccaagcacggtcgaagccgttcaagttaacggggtccggcagttggtaatcaaggactccaagtgggccctgacggttacctcttccacctcgagctctagttccaactcctctagttcaacgagttccagttctagttcttcaagatcgagttcttctagttcctcgagtgaaagctccagttccagttcgagctccagctctagttcttcaagatcgagttcttctagttcctcgagtgaaagctccagttccagttcgagctccagctctagttcgagttctagttccaccccgtctagttcgagttcctcaagcaactctgcttcgacgccaactcctgctagttccacccctacgacaacgccaacgacaccaacgcaataaagcactagctgaatacaaaacaagaggcctggagaaagcagctttctccaggcctcttgttgtctattcgaatgtcaaacggaaaacgtggccaataacatccaccctattcccgatacgccaagcgttggcgtccccgttgtaggatgtaaatggcgatgatgacgatgacaatcccgagcgcttccacccagtttaggttgaggctgaaaaagatcaccgataagatcgtcgtcacgattggttgcaccgcgtccatgatcgaaacaacgtcggacggggcgaagtgaatggcttctaacaagaggccaaacgggatcgccgtcccgaacaagacgaccgtcgccaccgaaccaaccagggtgacggtgacgtgaggcgggttaacccaaaacgggtggtagaggttaaataagatcccggcgatcatcgtcccccaccctaacaccaccagcggcgggttcgtttcgttagccttgcgcggcaagacgacgtaaaaggcggcggtgatcccggaaccgatcccccacaacagcgaaaccagcggaatcgccaagtgggcgaagtcaccccgggtgatgcaaaggaccaccccgaccagggcaatcacaaaggccaaaacgtcgctgcggattggccgttgccccctaaccacgctgcccaacacaataaagaggggcgccaggtattgtaaaatcgtcgccatcgaggcgttcccggtctggatggcgtagtaaaaggttaagaggttggccatcagcccgaagatggcgtatgtgatcaccgaaagggcgctgcgcttgtcagcaaaaatagcaaaggtcttcttaccgtacaaaaccagtgaaatggcaagcaataagacgccggcggaaaaggtccgcattgacagcatccacggggctgggatggccaggttttgcgagattagttgcaaaaccgtgccggaaatcccccagctccccgatgccaaggccgccagcaggatcccgcggctgacccgacgatagttattcatgttcgttccccctaaaattagttacgagtaccatcctatcataaacgaatagccggcgccatttctttggttggcaagggcggcctgcggggctattattaaaagaaaacgcttgcggaggaatgattatgcaactaaaagtagaccgttatcaaaacatgacttaccggcgggtcggcaagagcggcctcaagctttcggccattggactgggcttttggcacaacttcggctccgttgacccgttcgatcaacaacgggcgatcatcaaggccgccctcgacctagggattacctacttcgacctcgccaacaactacggcccgaccccgggtagcgccgaagaaaacctcggccggctgttgaggaccgacctaaagccctaccgcgatgaactggtgatcgccaccaaggccggctaccacatgtgggagggaccttacggtgagtggggatccaaaaagagcatcattgcgagcgccgaccagagcctgacgcggctggggttagactacgttgacatcttttattcccaccgccccgacccagagaccccgtttgaagaaaccgccctggccctcgaccagctggtccaccaagggaaggccctgtacatcgggatttctaactactccggcgcccaagctaaggaaatggcgacgatttttgacgacttgaagaccccctacatcgtctgccaaaatcgctataacctctttaaccgccaggtcgaaagcgacctcttccctgagctcaagcgggctggcaaggccatggtcgccttctcaccgctttgccagggcctgttaaccaacaagtacctcaacggcatcccggcggactcacgggcggccaagacgaccagccccttcttgcacccaagccaagtggaacagaccctcgccacggtcaaaaggcttaaccaaattgccagcgaccggggacaaaccctggccgaaatggccctttcctgggacctgaggagtgacctggtggcctccgtgatcgccggggcgtcgcggccagaacaacttgtcgccaacgtcatggcgcttaacgcccccgccttcaccgctgatgaactgacggcgattgacgctgctctggcggcccaggcggaggttgattggtcaagggaatagggaagtgtgacccaccggtaaggcaggccgtgggctaaggctcggacacaggttagcgcgtcagtggtattctgtggtctgacttagccactaggcctgcgggtggggagcacgttattggaagtgtgacccaccagtaaggcaggccgtgggctaaggctcggacacaggttagcgcgtcagtggtgttctgtggtctgacttagccactaggcctacggatggggagcacgttattggaagtgtgacccaccagtaaggcaggccgtgggctaaggctcggacacaggttagcgcgtcagtggtgttctgtggtctgacttagccactaggcctgcgggtggggagcacgttatcttaggaaagtgggaaataaccttctcggcaggtcgtatgactaagctcgggcgaacggttagtgcggaacgcactgttcttcggcctgcttaggcactaggcctgcggttatttaccacgttttctgtctaacatccgggaatacaacaagaggctgggagaaaactgtgttttctcccagcctctatttttctttcttagttaaacaagttttggatccaggcgatcagcttttggaaccagttttgggcgtccttgaccgccgtcttagcggcttcggagttggcccagttcttggacttgttcatcagatccccggtcgagtttttaacgttattgatcgtgttagtcacgttattaacgtaggtcttggaactagagatcggcgaatcccggaaggtaatcagggcgttgacgatcgtcgtttgggcgctagaactggtcttggaggcaatcccctggttctccagggccttggttaagatggcctggatctgggcggaatcgtcagtttggccgtcctgcttgtcttgggcgacttgcttagaaacgttcccgacggcggccattagcttacccgggtacgaggagtcgcccgagttttcgttaattgccccctgggtggcgtccaggacctggttggcggcgctggtgttttggctgtccaggttctgcccgtcagcggccagggccttgtaaaccccggtcaaagcagattcaccggacacggcccggttggcggtcacgacgatcgtaacgtcggttaccccggccatctgggccaccatggcgtactgttgggccgtcacctgggtgatgttggactcgccgtcgtacttcttgatgttaacccgcaccccggaacccgggtcggacggggcgatcgcaaccgatgaaatcatggcggcgttggtggtcgtcccgttgccgatgtacttctcatagtcactcgccgtggcggtcagcttttcaaacgaggagtcgacccccatcgtcgaattcagggtggagtaggcactctccggcgcccccgcaccgtacaccacgtaggatttggagatcgtgtgggtcgttgacgtggtactggatgatgatgaacttgcctgggtcgtcgtgtcggcgtgggcctgcacggcggggaccacggccccgccacagaggagtgccgctaccatcagcgtcgtcattagggttctttttttcatcgtaattcctccgttaatgaaagtacccttattatacccgtttagctaagcaccgggggctttttcagcacgatttagtgattaattaatggttgccggctactcagtttggtcggggtgcagttttttaagcgacgcctttaaaactaatggtttatcactggttgaacccgggcgcccttccccccgttgttcccgcgccagctcgtactggtgcttatcggccatcacttgttgtggcgtcgtcaagcggctctggcgccagcgccgcaagatcccttcaatgtacttcaagttgtacttaccggccagcaccgcttcttttagggccagctgaaccaaatctaactggtagtggtcctcatccagccactggttgaccgtttgcatctccatcggcgaaatcgtgcggccaaactcgacttggatctggttgaagagttcggaccggctgaggtcagcctgcttttgttcattgaccacccgctcgtggtttacggcccgggccaaacggtcgtagaggggggtgaagtcgtagtaggcgtcctccttgccatccggttggcggcgcaagcgctgttcaaccaggtttttcttggtcatttggtggactagctcaaacacctgcttggaactggtccccaggtgatcggcaaccagctcgaggtcgggggtcgggttcccccggtcaatgtaagacttcagctctaagtagaccattaattccccggtggtcatgtcgatgtcgtggtagtgatgcaacaagaggttggaaacgttggtgctccctgcctccagcatcgtcatcaagaattgattttccgccatttttcctcccccactaggtgctaacaagaggaggccgggaataaccgcagttttcccagcctcctcttgaatttttaactatcgctatttattacgggtacagacggtttaagagccgtgggaacggaatcgtctcccggacgtggtcttgcagggcaatccacgttaagaagcgttccagcccgagcccgtaaccggagtgcggcacggaaccgtacttccgcaggtctaagtaccattggtaatccttttcgtctaagccggcgtcagcaatggcttggcgcagggtttcgtagtcagtttcccgttcggaaccaccgatgatttccccgtagccttctggggccaagaggtcggcacagacgtaaacgtcgtcgcgagtcgggtggcccttcatgtagaacggcttgatcgccttcgggtaattgagcacgaagaccggcttagagaattggtcggctaagtaggtttcctccggagaaccgaagtcttcaccccacttgatgtccatcccggccttttgcagcatttcgatggcttcatcatagctaatccgcgggtacggcagctgggtgaacggctttaaggtttccggatcgcggccgagcacttctaattcgcggctgcagtcgtcaattaccttttggattaggtaggccacgtattgttcttgcagttccaagctttcttcttggtgcatgaaggccatttccggttcgatcatccagaactcgatcaggtgacggcgggtcttggacttttcggcccggaagaccggcccaaaggagtagacccggtttaaggccatcgccccggcttcttcgtagagctgaccggattgggacaggtaggcgtcttggtcgaagtattcggtgtggaataagtcggtcgtcccttccggtgcgttcccggtcagaatcggtgggtcgatcttggtgaagccgtgttcaccgaagaattcgtagttagcccggatgacccggtcacgaatccgcatcattgcttggggcttgctggaacgcagccacaggtggcggtgatcgagcaagaagtcgatcccgtgttccttgttaccaatcgggtattcatcggagtcgccgatcagttcgagttcttcgatttggatttcgtaaccgaacttagaacgggtgtcttcgtggatttccccggtcacccacaggctaacttcttggcgtaggtggcgcgccatttcaaaggtctcttcgtcgaccttgttttttaacaagaccccttggaaaaaggccgtcccgtcacgcagttgcaggaaggcaatcttcccgctggaccgcttatcggttaaccataccccaatgcgcacgcgttcgttgacgtgcttgggcgcatcaatgatgttgatggtttgcacaataattccctccaaatagtggttgattataagttgttgatttgttggatgctcttgccactggtgaaactaatcaggtcataacacaggttgcccttttggttcaagtaggtcacttcccaaaccggcttgttgttaaagatgcccatggccaccttcaacacccgcttggggttatcggccgttttaacctcacttttggcctgactagccgttaatccggcggactgcttgaggacccggatgtcgccccccttttgaggcaccaccaccaaaatagtttggcccttcgcatttttccccgccaccgtgtagtaggtttggtcccgattgtagatgtaaaaaccgctcgtggactttaaccccgcgtactttttcgccattgccgtagcctgcttttgggcggccgcccgcgggtggttagcaatggcgtacacgctccaagtgaccaagatgactagcaaaagcgtcacgacaatgttgcggaccgtctttttaaacgaccgccgactttgctgacgctgaacgtctcgccgactttgcatagaagccttccttcctaaaaatcaatatctttattattatagcaaatttctcactcgttcgtggccgattccggaccttttaggaattttttggtttttaccacgatcaaatcgctactttcggcgatcaccggcagatcactcggcaaggctgcctggatggttttaccgtaacgcttggtgacgaggcgggggtccaagacaaccgctaccccccggtcctgcggggtccgcaagagccgccccagcccctggcgtaagcgcgtggtggccttcggcagttccacttggtaaaacggattcttgccggccgccttcaagagggcgctttgggcccggttaatcacatcgttaggggagtcaaaggggagccgggtgacgaccaagagctccagttgttccttaggcaggtcaatcccctcccaaaaactagccgcccccatcaacagtgaattggtgccggtggcaaactgcttcaaaagcttttcccggttacccgagatcccctgggccaagatgtcgcgttggttaaagaggtcggtgttacgcaacttggcgtagacctgttcgatcgttagaagggagttgaacaagaccatcgtttggcactgggtcttggtggccagttggtaaatcatcttggccaggtaatcaatgtaatcctcgcccgccgtggcgcccggcgctggcgcatccttggccacgaagaggcgggcgttttgcccgtagtcaaagggtgatgcgaagcgtttcacccggacctgcttgcgatcgaggtcgagctggttaaaaatgtaggccgaccgccccgaggtaaagagggtcgccccgacgaagaggtggttcaaaaagtgggggtaaacctcgcggctcaggtagtggttagctaccaagaggcccccggacagcttgagggtgctttgctcgtccccctgacgaatcgtcaaccagaagacgcaggcctccggttggctagccaggagctgaccagcctccttaatcatcctggtggcttccttcaacccggccagctggctcgcaaactgggtcattaggtaacgatcggtcgccaaccaagtttcgctgcgggaggaaaagaggtggtttagggcggtgaagtggaggttaatcgccgacagggcctgctctagcccgaccattagcgggttggtcggggctagcatcccagctaactggcggttgtcgatggcctgttcaaccaattccccatcttggcccccctttaccaggccatagagggcctgttgaaagtccaccaggcgcccctcgagttcgcgcagatcgctcgctagtaactcgacgttgtaagcacccaggggaaggttttcaaacagggttaccaggttctgctccccggtctggttgaccaggttttggagctggtggaggatcatcatcacccgcgcgaaggtcagggtctgccgcgattgacggaggaccgcccggctcaggtgctgggcctcgtcaacgaccaaaaaggcgccccgatcgtcgccacccagttcagcggggtgggcaaccaagtaggcgtggttggtgatgattatgttagccgtggccacctggcgcgcccggcgaaccagaaagtcatcctggtaaaagggcgactgcttgttgagggtccgtaccccgcggtggcgaacctcaatgaagtaggccgcctgctgggcgtttaggttcaactcgtcgaggtcgccggtcgtcgtctctaacagccacaccagcatccgggccttgagcgcctgggccagctgggaatcctcgtgcacggccagcgagtgggcgaagcggtcaatacttaagtagtgatcgttacccttcaccaccaccgccgtcaactggaagggcaggtggtcgtttaagatggcaaccgtttgcttagccacctgctgttgcaagaggttggtggccgttgaaaccacgatccggtggtccgggtaggtcaaataggccagcggcaacaagtaccccagcgtcttccccgtcccggtgccggcctctaagaccaactggcggaccggctcgtcctgggagaactggttatagatggcgttcatcattttggactggagcgggcggtaggcgaggtcatcaccaaacaaatacttcttttggcgcttggtggccgggtacttccccgccacctgggcggtcggcacgctaaccgggcggaccttgtggaggaccaggccgtttgaaacgtacagctcctctttgagcggctggggttccaccgcccgcttggccagttcccgttcaaagagccaggccgtcttctgcggcagggtcaactgcaagtcaacgatgctttgcagggtgatggtcggcaggtcagccagccgctttaagagctcaattaggaggtgggcggtcgcgactgcgtcggaaacggcgctgtgcggttgatcgtggtcaatcgccaggtaactggtcagatcccggagccggaagctgggcgccgtgggcattaaaatctgactcaaggtaaccgtatcgatcgccgggatcgtcaatggcgcttcccccgcccgttcaaattcggcgtttaaaaagggaaagtcgaagttgacgttgtgggcgacgaaaatagtgtcatctaagaggctctttaaggtcggcgccacgtcttcaaacaggggggcgtccttgacgtctttatttttaattccggtcagttgttcgatggttaagggaaccaccgtacggggattgatcttggtttcaaattcgttgatgacctggccgtcttggaccaggacgcaaccaatctggatgatccgtgaaccggtcttaacgctagtgccggtcgtttctaagtcgaccaccgcgtacactggtccccgtcgttttttctttgccaaactaaccatcccttcgtttctaaaattcttctatcgattgtactacactttgcccaggcgacaggacaaatgtttagattttacctgtggataaaaagtgagggctttgcctaattctactggtcaactaagtcaaccttgccccaccgcccctagttagtggtaaaatgtagttttgcaggtgtaatgacaccacccgaaaaaaaacggcatctcaatagaaagcaggtttgacttcatgcaagcaagcgtcagtggtgagagccacgcaaaaattattttgatgggcgaacacagcgttgtctacggagaacccgccattgccctaccgctacccagcgttgccacggtggcaacattaacccggggtggcgtgggaaagcgcctgacgtcacgctattttcaggggccaatcgaggaacttcccgcctcaatgaccggggtgttgaaactgctcaacgccctgaccgaccgcttcagcccggacgataattgggaactgacgatcgaaagcgacctccccgccgaacgcgggatgggctcgtcagccgccacggcgatcgccattatccgggccttcttcgccgcttatcacgaggaactgagccacgcgcagctgcttgagtgggccgacattgaagaagaagttacccaccggagccccagcggcctagacgccgccaccgtttcctccagcaccccgctttggtacgtgaaggggcaaaccggccaagccattgacatggagctgtccgccaccctggtaatcgccgataccggcatcaagggggcgaccaaagaagcgatcgccgccgttaaagaacaactaacaaccaacccggcccaaaccaaggcccgtttcgcccacatggggcacctggtcgaagaaaccaaggtggccctagccaccgatgacattacccgcctcggcacggcgatggacgagtgccaacaagacctggtggcccttggcgtttcttcgccggccctcgatcacctggttgccgtggccaagcaaaacggggcccgcggcgccaagctgaccgggggtggcaggggcggttgcatgatcgccctcaccgctaccgccatgggggcccgcaagctagccgccgtcctaaaggaaaacggcgccaccgcgacctggattcaacccctgaaaggagaccattaacatgaccaccaccgcccgcgcccacaccaacattgccctggtcaagtactggggcaagcgcgacgccgccctgatgcttccgcaaaccgactcgctatccttgaccctcgacgagttttacaccaccaccaccgtcaacttcaaccaggcccttaacgaggaccagttttacctcgacggtgagttggtgagcgccaacaaggcccaaaaggtcgtcaagttcatggacctggtgcgccagctgagcggacgaaccgaatacgcccagattgcctcggtcaacaacgtcccgatggcggccgggctggcttcttcggcctcggcctttgccgccttggccggggccgccgctaaggatgccggcctggacctctccttaaaagacctaagccgcttggcccggcgtgggtcaggctcggccacccgttccgtttacgggggcctggtagaatggcaccgcggggtcgatgacgccacttcctttgccgaaccggtgcaagaagtccccgactttgacattgccatgttggcgatcctcgttgataccagccaaaaaaaggtctcctcgcgcggcggcatgcaactggtagtggaaacctcaccgtattacccggcctggcgcgaagtcgttaagcgtgacatggtggcgattaaagaggcgattgccaaccgtgacctaccaacgattggccacatcgcccaggaaaacgccctgcggatgcacgccctcaatttggccgccgacccgggctttacctacttcgacggccaaacgatcctggccatgcaaaccattgatcgcttgcgtgaggaaggcttaaactgttactatacgatggatgccggtcccaacgtcaaggtgatctttgatccgaaggaccaagacgacctcttaaacgccctcaccccgctctttggggccgagcgactggtggttgccaacccgggcccggggattgaattcctcacagaaccggtaatgaaattttaaatgagaggatctaactaagttgattactgcaaaagctcccggcaagctctacattgccggcgaatatgcggtggttgaaaatggctaccccgcaattttggttgctttaaaccagtttgttacctgcacgattaccgaagccaaggatgaggttggccaaatcattagccgccagtaccacgataactccttgcagtggcgccgccgtggcgatcagatggtggttgacaagcgcgacaaccccttctcctacatcctgtcggcgattaacgtgaccgaagaatttgcccgcagcctcaaccagcgcctggggatttacaacatccgcatcgacagccagctcgattcccaaagcggcaagaagtacggcctgggctcttcggcggcggtcacggtggcgaccgttaaggccctgtgcgaatactaccaactgccggtcaacaaggaaatgatctttaagctgtcttcgatcgcccacttcgacgtgcagggaaacggctcgctgggtgacgtggccgcctccgtttacggcggttggatcgcctaccggtcctttgaccgccagtggctgtccgaacagcgccactacctcgacttaccggccctgctttcactgccgtggccggacctcaagatcgaaccactcgatgccccggccaacctagccctgctgattgggtggaccggcaaaccagcctccacctcacgcctggttgataagatttcactctttaaggccaagcaacaagacgagtaccaccgtttcttggaccgtagcaaggcctgcattcaccggatgatcgacggttttcacaccggtgacctcgataagatcaaagaagaaatccgctacaaccgtaacctcttgcaggaattggcccaccgttccggggtccaaattgaaaccccgttattaaagaagctgtgccaaatcgccgaagaatttggcggcgccgctaagacctccggagctgggggtggtgactgtgggatcgtggccatcgatggtcacgccgacctgcccaccgtcctcgattcctgggctaagagtcgcatcgaacacctaccgctgtcggtctacttcgtcaacaacatccgccgctacaccctacaagttaagcaacgctaatccaaccacgaggcgggcgtcgataatgacccgccttttttaggaggtttttgcaatggaatctgctcacgcccagcgtaaaaatgaacacctttccctcgccgaaaaagactttgcgctcaatcaccaggttcacccctttgatcaggtgcgcttaataccgaatgccctccccgaaatggcggttaaagaagtcaaactcaagccagcgggcttggccctgccctttgagtggcccttttacattgaggccatgaccggggggagccaacggaccaccgccgtcaacgcctccctcgcccgcttagccaagcaatttaacttggcgatggctaccggttcgatgtcggtgatgtttaacgacgaggcggccaagaaatcatttgccgtccttcgcgaggaaaacccggacggctttttaatggccaacctgggggcgggcgccgattttaaaaaggcccgtcaagtgattaacttcattgacgccgacgccttggagatccacttaaaccccgctcaagaactgatcatgaaggagggcgaccgcgaattttactggttggaagcattggccggcttagttagccgcctccacatcccggtgatcgtcaaggaagtcggcttcggcatgagccaacaaaccatctctcaattagaacaaattggcgtgcggtggatcaacgtggccggcaccgggggaaccaacttcgcccggattgaggaccggcgtaaccacgaactcgacctgagtgacctggttaactgggggctgtccacccccgaaagcctcctggaagcccagcaaaagtcgccttccacccacttgattgctagtggtggcatcacctgcccactggacgtaatcaaggccggggtactgggcgccaaggcggttggggtggctggttacttcctccacctcctgatcaaagagggcgaagaagggttagccaaggaactacaccgctggcaagttgaactaccccggttaatgaccttggtgggggtccgcaactgggatgacctctacctagttgactacctgttgagcccagaactggaatcgttcacccggcaacgcggcttagtcaaccgacgggggatgggaaataccgcccacctcattaacccgcttggctaaagagagtttggcaaacaactttcccgacaggccgtaagtaaacttggacgaacggtgattgtccccctttttacctaacattcggatatacagcaagaagctggaagaaaaccgtgttttctcccagcttcttttttgtggattgtccaccctcttttacccaaagctcccggttaggtagtcctcggtcgcttggaggtggggtttagcaaacatagtggcggtttcgttatattccagcatgtggcccatgtggaaaaaggcgcagtagtcgctgatccgcgaggcctgttccaggttgtgggtgacgatgatgatcgtgcgcccctcctttaggcgggccaaggtttcttccagcttagcggtcgacagcgggtccaaggcgctggccggctcatccaagagtaagatttccgggtcgaccgcgagggtcctggcaatgcagagccgttgttgctggccccccgagagggcgagggcgcttttatccaggtcgtctttgacctcatcccaaagggcgacgtcttttaagacccgttcaacggtcgcatccatttcctgcttatccttcatcccgtactgcttgggcgccaacaagaggttttccctgatcgagcgggcaaaggggttggggtgttgaaagaccatcccaatcttttggcgcacccggtaaacgtcggtggtggcggtattgatatcgacatcgtcatagatgatcttgccggtcaccttggccacctcatcgttcatccggtttaagcaccgcaagtaggtcgacttccccgagccggaggggccaattaaggccgcaatttggttcttgggaaagattaggctggtctccaccagcgacggtttgtccgggcggtagtagacgcaaaccttttcggtgtgaaagatgctgggtcccgccacagcaacggtgtaggtttcgtttaaatcgtacgttttcattgctgttctcctattggcccaaccgtttcttgagcgcccgcccggttaaccgggcaccgacgttgaacaagagggccacaattaccaagaccgccgaggccccactggagatttggtgtgcgttggtcaccaacccctcggtgttgagcttccagatgtggacggccaacgtttcggctgggcgcatcgggtttaaaaagctatcggccgacagggggttccagttagcgtaactaaccgcgggaacactttgccccgaggtgtaaatcaaggcggcggcttccccgaagatccgtccggcactcaggatgatcccggttaaaacccccgggatcgcttcgggaagcataatcttggtcaccgtcttccagcgcgaaagccccagcgccaatcccccggcacggtgatcggcgggcacttcttccagggcgctttcgcagtttctggttaagagcgggacgttaaagaaggtcagggcgatcgccccagccaacaccgagaagcccatccccattttgaccacgaagaagaggtagccaaacagaccgatgacgatcgacggcaaggacgagaggacctcgatggccgaccgaatcaccttagtcacggcgttttttggggcgtactcagctaggtaaatcccggcccccaaggaaaggggcaccgagatgatgagggtcaagaccagcaaatagagagaattgaagagttggtccctgatcccgccccccatccccatgctgtcggcgggcgtggttagaaaggtccagttcacgtagggtaaaccggtcacgatgatgtagccaatcaaccccactaaaatcatgagcacgatcgcacacaggagatagatcacccccattgcaatgtgattcgttttttgcgcattaatgttgttctacccccttcttgttaatcgtccgcaccaacaggttgaagattaacgacattaagagtaagaccaaggccaaggaccacagggcgtcatttggtagggtccccatgacggtgttcccgatcccggccgttaaaatagaagtcagagtggccgatggtgaaatcgggctcgttggcatcacggcagcgttcccaatcaccatttgtacggctagggcctccccaaaggcccgggccatcccgaagatcacggcggtcaaaatcccaggcaaagcggcccgcaggatcacccggtgcatggtttgccacatcgttgcgccgagggcaaaagaagcactgcggtagtcacgggggaccgagcggaggctttcaatcgttagcgaggtgatcgttggtaggatcatgacgaacaacaccagggtcgccgtcaagatccccgacccggtcccaccaaagaggttgcggatcaccggcaccaaaacggccaggccgatgaacccgtagacaaccgacgggatccccaccaagagctcgaccattgattgaatcaagccccgcgagcgtttcggtgccagctcggtggtaaagagtgcaatcgccaaggcaaagggcgtggccaccaccgccgctaagagggtgacgctaaaggaggtcacgatcatcggcagggcgccgacgtacttagcccccgaggttgggtcccaggttgtcccggtaaagaaggttgcaaacgaaaccccatccttaaagaaggttgttaacccccgggcggcgatgaagtaaataatcgagaccaccagtagggcgatcaggccgatgcaaagcgtgctgatggtccgcccccaactatcctgcttacgctgacggctcttggtgtttaaagtcgtgtactcctcgctacttctttgtgacgtttccatctgcatccttagtcaccttcatatcgctgacgctgatgtaacccagcttttcaaccgtcttcttttggaccttggagctttccatgtactttaagaaggacttggtttcaccggttgccttacccttggtgtacatgtgctcgtaggaccagatcttccacttgttgttttccacgttcttagcggttggtgccaccccgttgatcttcagagccttaacttggtcggtttccgtgtaggagaaggctaagtaagaaatggcccccggcgtgttgtagaccaacttttgcaccgtcccgttggaatcttgttcctgaccgttgaccgcctttttaccgtccaagacggccttttcaaaggtagcccgggtcccggaacccttcacccggttgatcacgacaatcttcttatccggtcccccaacttgcttccagttggtgatcttaccagtaaagatcttgcgtaactggctcatcgctaagttatcgaccttcaagtccgggttgacgaccggagccatccccacgacggccaccttgtgatcttgcagctttttagcgtcaatccccgattgttgttcagcgaagaggtccgagttcccaatcgtggctgccccggaggaaacttgggaaagcccggttccggaaccgcccccctgaacgtcgatggaaactgacttgtggtcggacatgtagctcttggcggccgtttcagccaatggttgcagcgccgtcgacccgaccatcgagatcttggtgctggcgctggcggttgccccgccggccagggtgaggccaatcgttacgacacttactaaacttaccaacgacgttttcttcatgatggttcgtcctttctatcttgccatccagtcattactttacaacatggtctactatacgcagggcgtgtaaagaaagatgactaatttatgaaaacgttttgtaaatgttcggtaaagctttggctaaactacgctaaaacgccgctaccaaaaggtttcgtagcggcgcattcttttaaatattatcttaaggagttcataattaaagtgttaaaccgtttcaccttagccccaattgtaaattggtctgaaaaaagagcctggaaaactgttatttttcccagacccttattaatttttcgacgcttaagcaactaacgcggaaaatgtcctttaaaaccgcaagcccttggggaagaagttcttcagggtcccgttgaccaacttgccccagcctgcggcgtgttggtcgcactcaaccaggtaccagccgttctttggggcgtcctgaatagtgagggtatcgccgtggacgtaggttcgccaggccggttcgtccacttccacaacctgggtgcaagtggccggcttggtggctaacgccagcgccagggccggttcgaagcggttcttcttgaagacccccagctgcaggcccggccgaatgaggctcatctgatcaatcgctggcatccccaccggcaagtcatagaggtagtcaccaaagacgaccaactggcccgcttcgtaattaggcaacacctttgtttggaagtcttgccacagggcttgttgttccttagtgggggcaaacttactccgttgaccacggccttttttcttcttgtttttcttggtggggaggacgggttcttcaccgttcttaacgaacttagcaatgaagtggccctcgcccttgaagtgatggggaaagaggcgcagcgccttagttaattcggggttaccgtccgcccactccggccggctcctttctaaacatcccctcccccgagcacggggcgtcgaccaggatccggtcaaaaaaggccgggaactgcttttccagttggtcggggctttcgttggccaccaccacgtgcttagccccccaccgctccaggttttcggccaggacctgggcccggttcttaaagatttcgttggcgaccaaaaggccctcgtcattcatcttagcgatcaggtgggttgacttgccccccggggcggcgcacaggtccaagacccgttcgccgggttgcggatcggcaaactcgccgactagcatcgccgagggttcctgactgtagacccaaccagtgacgtgatcgaggctgtggccgtccactttgcccaggtacccgttggtaacgtaggggctttggcctgccgccgcttcaatcgttgcggttggctgacccggttttaaggggttggcccgaaagccactttggacggtcccggaagtcagggcagccaaaaaggccggtgcctcctcttttaacaggcgttggtacttttcaataaaggcagttggtaattgcacgatggtttcctcgttttcttttgacatccgtttcattttacccgtctaactaggggcgcgcaagatttgtcaaggcgctccttggtcggtataatcaagctattgactttaaaaagcgagggataagcatggaccaacacttgatcgccctagacatggacggcaccaccttaaataaccaatctaagctgaccgaccacaccgtcagcaccctgcgccggctagctaacgatggccacctggtggtgatcgtgaccgggcggccctggttgatctcggcgcacctttacgaccagatcggcctcaagtcgccgatcatcaattttaacggcgccctggcccacctgccctaccaaaattggaagcacgagtacgccattaaggtgacccgcgaactaaccctagacatgctagaaagccgccgagaactaggagttcaaaccctaatcgccgaggacaagcaccacgtctgggcgaaccacccgtcaaacgaactgccagaatttttgccggcccaactcagcgacgaccagatccttaacgagcgcaatttaactgacgacccgatcgccctgacgattcagtttgaccccgccaaaaaagacgcaatcatcaaccgggtcaacgagcgctacggtgactttgtcgaaccccgggtctggggcgggggctattcgatcatggagctgatccaccgcggcactcacaaggaaaccgccctgtcttatttagcccaccacttccaaatcgaccgccaacacatcgtggcctttggcgatgagcaaaacgacctcgaaatgatcggcttcgccggccacggggtcgcgatgcaaaacgccatccccgagctcaaggccgtcgctaaggacgtaacgaccctagacaacgagcacgatggggtcgctgattacttggagaagtactttcaattgtagtgagtgcgacccaaccttcgaaacgggccgtatagctaagctagggcgaacggttggtacgctagcaccgttcttcgcccatacttagatactaggcccatggttggggagcacgttatctgtgagtgcgacccaacctacccagcggaccggagttgcaaccatgttacctttagaataaaaagaaatgggctgggagagcacgtgctctcccagcccatttgtgtactgttaaattctctttaactccgccaaggtcttaatccccagctcgtccattaaggccggcagttgagcggcaatgtgggggcaagcggcgatgtctttgaagtgggcggccccaacggcgacggcactggccccggccatcataaactcaagcacgtctgcggcggtttcgatcccgcccatcccgatgattggcaacttggtagcgcgggccacttggtagaccatccggaccgctagcggcttaaccgccgtcccggagtagccacccatcccgttacccaagaccggctggccggtgcggatgtcgatgtgtaagcccaagacggtgttaatcaaggacaggccatcggcgccccccgcttcggcccccctggcgacctcggtaatatcggtcacgttgggggtcagcttaacgtacagcgggacgtcgccgaccacccgtttaacctggttggtcaacgattccaagaccttggcgtcggtgccaaaggccatccccccgtgggcgacgttggggcaagacacgttaagttccagggcactaactaaccccgacttggctaacttttcggccactaacacgtagtcggtttcggtactgccgccgattgagccgaccaccggcaggtccgggtactgcttagctaagttgggtagcttttctttgatcacggcgtcaacgccggggttggtcaagccaacggcgttcattaccccgtcggtcagcttggcaatctggggttgcgggttccccgtccgcgcctcgggggtggtagttttaattaccaaagcacccaggtcgttaaagttaacctggtcggcaccccaggcgtccccaaagccaaaggttccggaagcgggcatcaacgggttggtcatgttcaggccgggtaaggatacggcaagtcggttggtcatggttgggtctccttatagttcagtggttttaaaggacgtcatttcaagcgagcgcaacagggcgttcacggtgtctagggcggttaagagcggcacgtggtgttcaatcgccgtttggcggatgatgaagccatcggagttcttttcgtcgtcgtggcccatcgtgttgatcaccaggtcgacgtgcttgtctttaattacgtctaaaatagcgggttgcccctgttcgtggagcttagcgaccacagttgggtgcaagccgttctcttctaagaaagcggccgtcccgctggtggccaggatccggtagccaattgccaaaaagcgcttggccagcggcaggatttgggccttatcgttgtcttcgatcgttaacagcacggcgccgttatctggcacctccatgccggccccggcaaaggccttgtagagtgccttttcgtaggtggtgtccgaacccattacctccccggtcgacttcatttccgggccgaggtaggagtcaacgtcccccagcttcgagaaggaaaagaccggtgccttaacgtgaatcatctgactttccggcgccaagccgcttcggtaaccttgttcagccaggctgtggccgaggatcaccttggtggctagctgggccattttgattccggtcaccttggacaagaacggtaccgtccggctggcccgcgggttaacctccaagacgtaggcctggccgtcgtggatgatgaattggatgttcatgatccccacgcacttgagggcgacggccagcttcttggtcgcctcttcgatttgaacctttaccgcgcccgaaagtgattgcggcgggtaaacggccatcgaatccccggagtgaaccccggcgtgttcaatgtgttccatgatccctggtaagaggacccgttccccgtcacaaatggcgtcgacttcacactccgccccttccaagtaggcatccaccaggattgggtggctaccggtgacgtcggcgttttggtttaagtagtccttcagttcggcttgaccgtaaacgatctccatcgccttgccccccaggacgtaactgggccgcaccaggaccgggtagccgatctccttagcggcgtctagcaccccctggcgagtcgtagcggtcatcccaattggttggcgcaagttcaggtccttgatcacctggtcaaagagctcgcggtcctcggcggcgtccaggtcggccacggtcgtccccaagatcttgaccccgtttgcctccaacccggccgctaagttgatggcggtttggccaccgaactgaacgatggcgccaactggttgctctaagtcggtaacgtttaagacgttttctagggtcagcggttcaaagtagagcttatcggagaccgaaaagtcagtcgagaccgtttcggggttggaattgatgacgatcgcttcgtaacccaacttttgcagggcccggacgcagtggacggtcgcgtagtcaaactcgaccccctgcccaatccggattggacccgaaccgatcaccaagacggacggcttagcgctgcggcggctttcgttttccgtttcgtaggtcgagtaaaagtagggcgttgccgagtcgaattcggccgcgcaggtgtcgaccattttgtagaccggcacgatcccgttagccttgcggaaggcacggatggctgccgggttttggccgagtagggtcgccaaggtcgtgtcggcaaagccgtcgcgcttggcttcgtaaattacctccttgtccaaaccagcggccttgatccgcccctcttcttcaaccaacccggccacgatgtctaagaagtagtggttaatccgggtcagttcgtggaggtcagccagggaataaccgcgccgaaaggcctcggcgatgtaaaagaggcggtcatcttgggcgtggacaagtttgtcttctagttggcgatcactagcggcggcggcttcttttgacaagaggtccttttggtcgatttctaaggacgcgaccgcctttaagagcgcttcttcggcggtccggccaatcgccatcacttccccggtcgccttcatctggctacctaggcgccggtcggccttggtaaacttgtcaaagggccagcgggggagcttaacgaccacgtaatcaagggctggttcaaactcggcgtaggtcgtcttggtgaccgggttcttgatttcgtcgagggttaagcccaccgcaatcttggcggctagcttggcgatcgggtagccggtggccttagaagccagggccgaggaacggctgacccgcgggttgacttcaatcacgttgtaatcgtaagagttgggatcgagggccagttggacgttgcagcccccctcgatctttaaggccgaaatcagttttaacgcgcagtcccgtaagcgttggtactcgcggtcggccagggtttggctgggcgcaaagacgatcgagtcgccggtgtggatgccgaccggatcgaagttttccatgcaacaaacgaccatcgtgttatcggcggcgtcgcgcatgacctcaaactcgatttccttgtagccggcgatcgacttttcgatcaagcactgggtggccggtgatagttcaaggccattcttggcgatttcggcgagttcggcctcgttgttggctagcccacccccggtcccgcccatcgtaaaggcggggcggacgatcaccgggtagccaacggttttagcaaaggccagggcctgttcaaccgtgctgacggtcaaggaggccgggaccggctcacccagttcttgcatcaattccttgaacttttcgcggtcctcggcctggtcaatcgaggccagtttggtccccagtagttcaattcccagttcgtctaggatcccggtctttgaaagggcgacggctaggttcaacccaatttgcccccctaaagtgggtaagagggcgtcgggggcctcctggcgcaaaatccgggtcaaggccgccaccgtcagcggttcgatgtagacgtggtcggcaatctccttgtcggtcatgatcgtggccgggttggagttgaccaaaacggtttcgtaaccctcctcctttagggctaggcaggcctgggtaccggaatagtcaaattcagcggcttggccgatgatgatcgggcccgagccaatcaccatgatcttgtgaatatcagtgcgcttcggcattagtttcgtcctttcttgcgttggtcgaccaggttaatgaagtcatcaaagagctgctccgcatcgtgcggtcccggggccgcatccgggtggaattggaccgaaaaggccgggtagtgcttgtggcgaagcccctcgacggtgccgtcgttaatttcgacgtgggtgatcagtaaccggtcggggtcgatggaggtggcgtcgacggcgtacccgtggttttgcgaggtgaagttaacctcgccggtcgccacgtttttgaccgggtggttgaaaccgcggtggccaaacttcatcttgaccgtcttggcgccgttagctagggccaagatctggtgacccatgcaaataccaaagacgggcaggtgttgttcaacttctttaaccatttccgcggccgccgtcatttccagtgggtcgccggggccgttggacaagaggaccccgtcggcgtgcaaatttaggacctgggtggccgtcgcggtgtggggtaagacgatcacgttacagtcgcgcttagccagttcccgtaagatggagtgcttgatcccaaagtcgaccaccacgatgttgcgcttggtgcccgggttgggataggggctcttggtggaaacgagcgggatgatgtttttcatcggggtggcttgctttaatgcggccactacttggtccaggtcggttaagtcatcgaccagccgcccccgcagggttccgtgttggcgcagctttttaaccagggcccgggtgtcgatcccctccagccccggaatcccccgctgggtcaaaaagttggccaagtcgtcttgcatccgccagttagtggcgacgcgggccagtttgcggcaaacaacccccttgatctcgggaagcagggattcgtcatcatcgaggttgacaccgtaattcccgatcagggggttggtgaagaccagaatctggttggcaaaggactggtcggtgatcgcctcttggtagccggtcatgccggtggtaaagaccacttcaccggtcttggcttggtcggccccaaaggcggtgccacggtaagttgtgccgtcttctaagacgaggtagcgttgcacgttagttctcctttcgttggtaaaccacttggccgtcaaccatcgtcatcacggtttgcccgtagacggtcatcccggtaaagggtgaattgattcccttggacaggtagtcacgctggtcgatgacgtaggggtggttgaggtcaaagacggcgatgtcggcgggcttaccgacctctaagtgaccggcttcggtcaggttaaaggcttcggcggggttggtggccatcaggtccaagagccgctctagcttcaagagcccggtcttgactaacttggtgtacaacagggcgaaggccgtttcactgccggtgatcccgttggccgcgcagcaaaagtcacgacccttatcttcttcggtgtgtggggcgtggtcggtagcgatcatgtcaaccgtgccatcgtttaaagccgccactagggcgcgccggtctgcttcgtggcgtagcggtgggttcatcttgtagttactatcgtgaccgtcaatgcactggtcggacaagagcaggtggtgtggggtcgcctcgcaagtcacccggacgccgttttgcttggcaaagtggatcatcgccaggctatccttggtggaaatgtgacagacgtggtagtggaccccagtggccttagccagggcgaggtcgcgagcgacttgggcggattcgactacttccggggcgccgggtagtcccaggtagcgggaccggtcccctcccgtcatcacaccgccaaagagcagcgattcgtcctccacgtgggcggctaacggtaggcccaccgccttagcggcctgcatggcccggtacatcgtccccgccgcttggaccccgctaccgtcgttggaaacggcgaaggccccggcccgcttgacgccggccatgtcaaccacctcgtcgctagtccggtcggtcgtgatcgccgagtactgggcgatgtgaaccaggccgtcctgcttatttttagcgaccatctgggccaccttggccggggtgtccggtaccgggtcgacgtttggcatcgccccgaccgtggtaaaaccaccgtgagccgcggcggccgaaccggtcctgatcgtttccttttcggtttggcccggctcgcggtagtggacgtgcacgtcgactaaaccggggctgaccaggaggttgccggcgtcgagttcgtcgtaatcatcgtctaggtactcgtggaggtccttgccaattgcccggatgatcccgtcttccaccaggacgtcttctttaaccaggcggccatcgttgtagacggtcccgtttttaattagggttttcattattccaagccccccagtttgcgaccgcgcagtacggcttctaacatcgccatccgcatgaagaccccgtttttcatttgggcgacgaaggccgactttggggcttcgactaaggagtcggctagttcaacgccccggttaatcgggcccggatgcatgatgatcgtgtccggcttgagcagggcgtagcgttcctcgttgatcccgtattgcttgtggtagtccgccgccgagaagtccccttcgtgggcatcgccggcgtggcgttcgtgttggacccgtaagagcatcatgacgtcgacttcttcgaccagttcgtcgatcggtaagaacttgccgtacttgtcaaaggcgtggtcgtaccagtattccgggccggagaagtacacttcggcgccgagcttgtttaagatttccatgttggagcgggccacccgggagttggtgatgtcgccgacgatcgccaccttgaggcccttaaagtggccaaagtgttcgtggatggtcatgatgtctagcatgcattgggatgggtgttgaccagagccgtcaccaccgttcacgatccccaggcctaggtagtggcccgcccccgggttgatcagtggcaggtagtagtcgttttcggacgcccggatcaccgttaggtcaacgcctaaggcatccagggttaggcaggtgtcgtaaagggtttcgccctttttaatcgaggagtgggacgcgtcgaaggggatttcggttaagcccagcttcttttcggccatcgcaaaggaggtgtgggtgcgcgtcgagttttcaaagaacatgttggtcacgtaaaccggctggctaagtttcggtgtcggcgcgccgttcttgaattcttcggcccgggcaatcagggcgttgacttggtcagtcgttaaatcctccacggaaacaaagtgtggtaaagaaaccagttgttcaacgagttgggtggtcatgagacattctccttttctgtgccccaaagaaaaaacctccccggggcaacttggcgctgctccagggaggttaatcgttaccactaccgtctttaatccggaaagcgtaaccattttgccctcgctggagcaatttgatggtttattctcggctgtcccaaaagaaaaccctccactcgcattccgcaagtgaagggttcaacggtggcccaaaccgggcaatttctccgttacctttctagcctcacgggactagcttaaaggacatctgattgctaataatataccccttctataggggggtgtcaaggcttggtcatcaaagttttgattgatcacccgttacccttcaggtcggcgtttaacacgtcggtgatcaacatgtggccgggggcgtgggtaatcaccagcgggagcttgctttgcatgatcgcgttttgcggggtcaccccacagggccaaaagaccggcagctccccgtctttgatcgtgaccggatcgccgtaatcggggtgggacaggtccttgatccctaacgaagcggggttgccaacgtggattggtgccccgtggactctaggcatcgccgccgtcacctccaccgccttagctacctggctagccgggattggccgcatcgacaccaccatgttaccgtgcagggcgccggcaccttgcaggggtaagttggtgttatacatcggcacgttgaccccctcggtgatgtggcgcacctcgatgccggccgccagcaattcggcctcaagcgaaaagctacaaccgatcaaaaactaaaaagcgactgatactcatcaacgttagtatcagtcgtttcctatttatctagaaatcataaatgtgcaattcttatcttaaatctgacaaaatctactatattctttctaaatctaattgtcttcaatattagcataataatcagtggaagacatcgtttctggcaaagtggtgttaaatgctttattattactatcatttaagtaggcataatcgccattagctaatttaacagctaagcctattccaatattttgaagtgatgtaccgttttcgtatttagcagaccacttagtaatatgagtagttggatcaggagctacgccggtagaaatggcccttgtggtgaacaagtcaggatacttggactgtaactctgacagatacttaccaccataagtttcctgtccgtttccaccaccggttgtgtatgcaaagtacatttgattagcatatgtcttaccattgacgtaagtctgcattccacgattgtcagctctggtaaccgttactgcttcttgaccgggaaggccaatcatctggttcataacaatatcttcctgaacctttaagccagcgctatgcaaagcggcaatcgcgtttgctaattcttcaccacttccatacttggttggattagcattagtccctaggttatagcgatcagctacagaataaccttcgttatagcgactcgtaccagcctgtgtgtaagcaggggccatccagaagtcagtgattcccaggttgttaaagagctcagcgttttgggcaataatattatatgcatgattctctgtacttgttggtttaggttgatacatactaaagtcttcatagatcatatgagaatcaagtgcagcattagattcgaagatcttattactatctgctgaaacagtggcggcattagtagtaacatcctgatttccagaagcaactgggacccacacaccaaggtatccacttacataaggattgctgtatcccttaacagtaaccttcaaaataccattatcatcagttgttaaggtctctggattttcagcaccatcagcattatatgttaaaccattatccgttgtgtcaagcaaattacgatactgctcattagcatgggcacgacccatattaatagaaattgtttgctctgccatttgtggattgttaccaacgataactgccattccactcgttcgactcaaactatcagtaccctcactatttgcattagcaacgcccttaccataacgaacgcttgcaattaagttatcgctaagcttggtcattgtttgtccgccgctaacaaattgtttccgtgccttcattaatgtcgtaattgcatcatagtagatcgacttttcctgcatatattgtgcagtttcgttgtaaagatcaccatagtaaatctgcggtacagtatctttattgcttagaagaattgcatattgtgctggaacgttatactgggcatactgcttatcggtcttcttttgatcagcataaaactcttgccaagcttggttagcatattctgctttatatgctgatcccatgccaggatggtctttaataattaacccattaatcaagttattgcgtatatcatggttagtgacatatgaccagtttggagtagcttcattttccgtaacgtcattttgccggttaacaatactatcagtaaccaaatgactaatagtatcacgattgttagcacgtccgaggacattctctaaagtattgcattctctagcatccatgaacaattgtggattacccttcttgttcaacatccgggcagcacctggaccgtatccttcgttatagcttaagtgattattagcattttgcgggttacccttcatatggtacatatcattcattaattgtccgatctggtcgagcacatcagcatccatatcatcagcagcatcaatccggaaaccatcaaaattaccatcctggttataacccatcagcttaccataatttaacaagaagtattcccagttaaggttctcagcttgtaccaccggattagagttatcaatatcatttccaaccacaaactcaggacagtaatcgctattatcattaccagtttggttattgaccgtacggttcattaagcgatacttactatcagcgtaactagtattatcattattaacgaagattacttgaccgcttccgctttcatcaggtaattcagatgaagccgatagttccggaattgtagttataaaattatttatatcattagcaagctgacttgtgctcttagctgctacaatatgttgttcaattacataacgtaagttttgagcaacttcattcaagttaatagaagcagtgttttcagacaaatctttaactgaaccagctgttaaaccataattactattttcataaccatgatttacaaagtactgaataaatttaacttgaacatctttgctaggccaaacgtacattagaattggacgccaatcagctactgtggttggataccaagtcttaccatcctggcttgtaccatatggacgataccaaccagtataactaatatacccatcaatattattaatagagttcgaatccatactatacgccatattttcccatggacctgcttcaactgtcttaattaaggaatggtcagcaaggctataaatattcagcttaccgttttcaatctttccataacgatttccaagtaaatacccataattactgaatttgtatactttaccatcaatcgtctgttgccctgttacagccgcactatcattgccaaaatagtacttatctccatgaatagttctaaattggtttgaaatttcttttccttgatcatcaaaataataaagacgattattaattgtgactagcttagagatggcttgtgcaccatcttcatcataataattaccgtctacccacttattagtaacttttaagtaggttactggatcaaagtagtaccattgattattcttatcccatttgtatagtcccgtggcaatccgaccatctttaccaaacatgtaccagtcgccccattgcgattgaacataattatcatctacacgtaaatgtgtctgcggatcaaagtaatagtaggtaccggcccacttagcaactcgactggctgcagtaccatctgcagtaaagagataccagtgaccgtcattagcctgaatgtaattattcgttacagccaagtacgttgtcggatcaaagtaataccattgattatttttatcccacttatacaaaccggtagcaatccgaccatctttaccaaacatgtactttaagccccattgtgaggtaacataatcatcatccactcgaagataagtagtagggtcgaaatagtaataagttcctgcccattgttgaacaccactcaagattcgaccatcgttaccaaataagtaccaatcaccccactgtgattgaacataattattgtcaacacggagatgtgttaccgggtcaaaataatagtaagtaccagcccacttagcaactcgactagccgcagtaccatctgcagtaaagagataccagtgaccgtcattagcctgaatgtaattattcgttacagccaagtacgttgtcggatcaaagtaataccattgattatttttatcccacttatacaaaccggtagcaatccgaccatctttaccaaacatgtaccagtcgccccattgcgattgaacataattatcatctacacgtaaatgtgtctgcggatcaaagtaatagtaggtaccggcccacttagcaactcgactggctgcagtaccatctgcagtaaagagataccagtgaccgtcattagcctgaatgtaattattcgttacagccaagtacgttgtcggattaaagtaataccattgattatttttatcccacttatacaaaccggtagcaatccgaccatctttaccaaacatgtactttaagccccattgtgaggtaacataatcatcatccactcgaagataagtagtagggtcgaaatagtaataagttcctgcccattgttgaacaccactcaagattcgaccatcgttaccaaataagtaccaatcgccccattgtgattgacggtagtcattatctacacggaggtaggtcgttggatcaaagtagtaataagtaccagcccactgttgaacaccagattgagcaataccgtcctttacaaaataccaattcgtatttccttgaacatttgtatctggaattgtaggtaattgaacatattgtgttcccttcaaatcttgatcagttttaccattgtatacccactggttattagcatttttttgccaatcagttgtttgctggcctttattctgatcgttgttacctgtagatccattatcattgccagcgctttctttttgatcttgtccattttgagactgattcgttttaccagaattatttggctgagggacagtatttcttacatccccagtattactagtttttccttgatcagaagctggctgactagtattagttatacccttctcttgatttacttgggcttgaggagttgaaccaccagtagttaatgtatccgcttgatactgattcgttttatcagaattatttggctgagggacagtatttcttacatccccagtattactagtttttccttgatcagaagctggctgactagtattagttatacccttctcttgatttacttgggcttgaggagttgaaccaccagtagttaatgtatccgcattaacagtagtattgccagctactaaacctaatgttgcggtaaatgttactactgccgcaatacaccattgcttgccacttttgtaaagtttaaagtgtttcttaaattccataactattcctcttaaatttaattattacgttataaatataacgcaaaaatagaccgttttcaattgaaaatctaatcgcttttgaacttcttctactgtttctagaggtgcaccactagtggttgccacagttcttgaccatcaacgttgctcttcttcccccagagtgccttaacttgtttagatagttctttcattactcaattcccaatatttttaaaaccgctttcacataacttttgtattatagcaaaatttttatcaaatttcatttcaccttgccttcactaccacctccattaatgactattctcccacaccactcggacatatcatgtcgctagccaaaaaaagcggctctttgtcaaatcctgttgatgggtcattttaggcggcggccggtgcttgcacctggcgccgccttttttcagcttccgttcccatttgatgcaatcggatccgggcgatgaaatgaccaaagttagtaaagccatatgccgtccgttgaattaacttgatcatgcggttgatcccctcaacccgaccgttggagtacggtaatacggttgcgttgtacactccttcgctgttcttacggagggtcttaagaaccgtttggaacggcgctggcacgtcccatttggtgaacaagaggtccattaattggtcaacatcgtgctcttcaagagcggtcatggcgccctgtaagagttcataaccggccgctaactggggatcaaggtccaggccaattcccacccgttcggccatcgttaccttttgtcgtaagtggcgatcatagtactccttagtgtagttaagcgatgtgcttttaagtaagtacagtcgccacgaattcttcaatgcccgatactcacgcgtattagggtcgaattgcttcattactgcgacccggacttggttaaacgcccgcgtaagcattgaaacgatgtggaatcgatccacaaccagctttgcgtttgggaagtagcggcgtacaaggccttgatagtaactgtttaagtctgtcgagactgatttgactcgtttgcgctcttttagcgagaatcgatcaaagtaatgcgtaatactactcttaagccgatcagggagaatttggtagatttgtgaggtatcattatcaacgataatgaagcaatacttcccctgcggaccacggaactcatcaatggcaatattagtgggtaaagtgcgactattaaaacgaaggagcgcttgatcactgtctaggagtcggccaatggtactaggtgacacaccggtaaacttagacacgtccttttgagagacattactttcaagcatcgtaagtgccttgtgtttaactgctttggcaatggaacagtatttatcaacgacgttggtcttcgccatgaacgaatcttggcaattcttacatctcaggcgttgcttaccgatccgcaacatagtgggacaactttcgttaattgagaggtacttaatggtttggtaagaatggccattcttaatgaaggtatccgcaaagccgcaatgtgggcaccaatccaatttaagcgagaccgtcccaatgaagacctgcgtctcccatccgtcattattttcaaagacaacgtctgtgaaatgaagattggggtctttaatttgaaggatatttttaatataatcagtcataaggtcacacctcttactttctggaatttgcgtggtagttaatgatcagaattttaaggctggtggggcctttttttgtgccctcaaaaccaaaaaatcctgtcaacgaattaccactatggtaatccatcaacaagatttagtgtagagccaaaaaagcccaaatttccataaaaaaaagagactggaacaaattccagtctctttattaggcattgacctagtcaagagtttacttgtcgcgacgacgttcagcaatgcgggcactcttaccagtccgttcacggaggtagtagagcttagcacggcgtacacgaccgtagcgtacaacttcgatcttttccacccgtggtgagtgaagtgggaaggtccgttcaacaccaatcccgttactgatcttacgtaccgtgtaggtagcggagatgccagcaccgtggcgcttgataacaaccccttcgaagatctgaacacgttcgcgggtcccttcaacgatgagggcgtgtacccgaacggtgtcaccggcgcggaaggccggaatgtcactgcgtaactgaccagcagttaccttttcgattaattgattttgacgcataatatttctttcctttcgccgacattcattaattcccttggaaccagcggaataccgtttatgcggcttacatagccaacaactaatgtaccatttctcccgctaaattgcaaacggaatttagcccttcttagccaaggtggagtggcgaatcccatacaagaagtagactagcaggccgatggcaaaccaaccgaccatcatccacttggcatcaacgtttaagttccaaaagataacggccgaaaagatcaccgataccgccggcaagatcgggtaacccggcatcttgaactgggcttcgggtaggtccttcccttcgcggcgccgcagggagtaaatccccagcgaaacgaagatgaaggccaccaaggttccggccgacaccagggttgctaagaaggtgaaggggaaaatcgaccccaaaatcatcgccaacacggtgatcgtccacagtgcccggtttggcacccgcttggcgtcgacgtgacccaagaaagacggcaggagcccgtcacggccaaaggcgtaaattagccgtgaggaggccagtaaaatggcaatcaaggccgagaagatcccgatcaaggcgacaacggataagaggttggcggtcaggtagtggccagactcgcgcaaagcccaagcagctggttcggcattgttggcgtagcgcgagtacttaaacatccccaccaagaccagcgaaacgacgatgaaaaagctagtccccaaaactaaggtgccgatcaaaccacgcggcatcgtcttttggggattcttggtttcagcggtattggcggcgattgcatcgaagccaacgtaggcaatgaagatctgcgaggccccggccataatcccggtccagccgccaaacgtggtccccggccggtgtgcgggaataaaggggtggtaatttggggtgtgaatggccgtcgccccgaccacgatgaagaggatgatcaccaagagcttaatggcgacgatcgtgttttcaatccgggcgacctggtggaccccgtgggataaaagccaaccaactgctaagattgcgatggcggcgaaaatatcgacgtacgaaccactggcggggttaaagcccccggtcagggcggtgggcagtttaatcccaaacgaagcgagaaagccctgcatgtaagccgaccagccggaggcgacaaaggcaactgagataaagtactcggctaatagggcccagccggcaatccaaccaaagaattcgccgaacaagacgttcatccaagaaaaggccgagccggcaaagggcagtaccgaagcggtttctgcgtaagccagggccgacagtccggccccgatggccgccacgatgaaggctaacggcacggccgggccggtgtgttcggcggccacgatcccgggcaaggtgaagatggcggttccgaccaccatcccggtccctaggccaattaagtcgatggtgcgtagggttggctccagttggccgtcctttaattggtagacgctggggtcctcttgttttacgagacgagcgattaattttttcatgctgggccccctacttcggtgcgtccggatccaagtcgagcttgaggtcttgcaagatgatctgttgttcccgactcagcttggcgttttttaataaatcggggcgccgttctagcgttcgtttcaatgattcacgcatccgccactcccgaatcttttcgtggttaccgctggtcaagacctccggcaccttcatcccccggaagtcagccggacgggtgtactgcgggtattcaagcagcccgttggaaaacgagtcgcccatcggagaagacatgttccccaacaccccgggaacaaagcggacggtggcgtccaccatcaccatagcggccaattcacccccggtcaaaacgtaatcccccaaggaggcctcatcggtcaccagctggcggattcgttcgtcatagccctcgtagtgaccgcaaataaaggtcaggtgttcttcttgggccagttccatagcaaagtcctggtcaaagcgccgcccggccgggtccatcaggatcacgcggcccttgggataagtgtccttggtttcttgttcaatggcgtccatggcgtcaaagattggctgagcttgcaaaagcatcccggcgcccccaccaaagggggcatcgtcaacgtgacggtgcttgtcggtggtgtactggcgaaaatcagtcaccttaatatcaacaaagccatcgtcttgggcccggcccacgatcgattgacccaacgtagcgtcaaacatgtccgggaagaggcttaaaatatcaatccgcattattccaatccctccaagagttccacgatcaccttgccaccagctaagtcgacttctttaaccacgtcatcaatcaccggcaacaagaggtcggtcttttgttcgcggtcgaccacccagacgtcgttagcacccggggccaggatttccttgatcttccccagcacccggccgtcaacggtttccgccgtcaagccgatgatttggtggtagtagtactgcccctcttctaattccgcttggtcttgatccgccacctttaactcggcgtcacggaagtgttggacttcgttgatgttattgaactgcttaaacttaaccaacaccagccccttgtgcattcgggcgtgttccaccgtcaattcgacgggcgcttgatcctttttcactaggtataaagtggcgccatcggcaaagcgttgatcaacgaagtcggtggttgcgaccaccttgacttccccccgaatgccgtgggtattaacgatttttccaaccgtatagagttccattcgctcgttcctctttcttttatctaccttaatgtaaaaaactcccacaaaggcttgtgggagttttctaatgacggtggtcatgaatgatcagccgaattttcttgtcattcacccgcttatcacgagccccttcgacaatggtccgcaaggctgcggcaacgtgtccttgacggccaatcacccggccagtatccgtagacgcaacggtcacccggaactgatggtagcgagaagtattttcttcttctaccttgaccgcctcagggtgtttcactagcggtgccactaaggcaaccactagccccttaaaatcaacctctttcatgaccgatcacaccattacttcttagcgtacttggcttcgtggtacttcttcataacaccggccttttgcagcatgttgcgaacagtgtcggaaggttgcgcacccttttgtaaccattccatcacagcgtcctcgtcgaacttaacttgctttggcgtggtcagcgggttgtaagtaccaagagaagtgatgaagcgaccatcacgtggtgaacgtgagtcggcaacaacgatccggtagaatggacgcttcttggaacccatccgctttaaacgaatcttgactgacatagtgacacctccttaaccttttttctaacaggtaataatataccaagttttccaaggattgtaaagtagtttttcttgacagcctcggaaatttttctggttaatggttaggcgcccctacgacattgcctacttagcttcacctagcttacgcttaaccaggtccgggtcggtcttgccgggatttaattcgactaacttcccagcgccgatgtagataacccactcggctaggttaacgatgtggtcgccggcccgttccaggttccgaataacggtcatgtaggtttccagggctggaatcgccgcctggtttttcatcatcgccgctaagacccgcttttgttcggtcacgtaaatcatgtcgaccttcaagtcctggtccgccacttcgtaagccgccttttcgttggtgtaaacgtaagcgtccatcaccttttccagcatctggcgcacaatctcagtcatcttttcaatttctttttcgatctcaccgttgtggtttttcttgtcgaagttgatggcggagcgggcgatgtgggtggcgtaatcccccaaccgttcgacgtcgttagaggcctttaaaatcgaaatgatcttccgaaaatcgctggccaacggctgttgcagggccattagcttaagggcccgcttttccaggctgatttcttcgtcattgatctgggcgtccgtggccaacacttcccgggccagggcgctatcgtgatcggtaaaggccttagccgccttataaatctgctcggaagcgtcgatccccatttccataaaacgggtccgcagtttttttaattcttcgtcaaaaattacacccattgttatttccccctttagccaaacttcccgttgaggtagtcattggttgcttgttcgtgtggattcataaagatttccgtcgtttggttaaattctatcagctttccttggtgcataaaagcggtccagtcagaagcccgtgaggcctgttgcatgttgtgagtcacgatgatgatggtgtagtttttcttgaggtccatcatcgtggcttcaatctgggtggttgaaatcgggtccagggcgctggtcggttcgtccatcaagatgatctcgggccgggtggccagcgtccgggcgatgcacagccgctgttgctgacccccggaaagagaaagggcgctgactttcaagcggtccttaacttcttcccacaaggcggcctgctttaaactctcttcgacccgctggtctagcacctgacgatccttttcaccggtcaaacgcaagccgtagatgacgttttcgtaaatcgacatcgggaacggggtcggctgctgaaagaccatcccgatctcttggcggaccttgtagacgttaaccttgggttggttaatgtcgacgtcatgaaagagaatttgcccggtgacgttggcaatcccatcgttcatccggttaatgctccgcaagagggtcgacttcccagaccccgaggccccgatcaaggccgacacctgatttttcttgaacttcattgagacgttgtgaacggtcggttcggccccgtaggccacggaaacgtcctttaattcaagtgcaatgttttcttccattactgttcctccttattgacggaagtgcttagcaaccaggctaccggcgaagcgggccaagaggttgaataccaaaatggctaggattaagacggcggcggctccggccgagaccgccgttgcgtctggaatcagtccctcggtgttgagcttccagatgtggacggctagggtttcggccgggcgcatcgggtttagaaaactcgtttgactgaacgggttccagttgctgtaagaaacgttgatcgagctctgcccggccgtgtagattaaagcggcggcctccccgaagatccggccggccgataaaatcgccccggtcatgatccccggcaaggcagctggcaccacgatccgggttgtcacccgccacttggccatccccagccccagacccgcttggcgttgcaagaagggcacctgagacagggcggtttcacacgaacgggtcaacaacggtaagttaatgatcgtcaaagcgagtaccccggccaacagggagaaatccatcttccactgcaacacgaagaccaggtacccaaacaagccaactaccaccgatggcaatgacgaaaggacttcgattgccaaccgcagggtattggtgagccggttttgcggcgcgtactcactcaggtaaatggccgcccccaaggataacggcaccgaaacgatcagggttaagacgaccaggtaaaaggagttaaagagctggtcgcgaatccccccgccggccgtaaaggaactggccgggctggtcaagaagtgccatgaaacgtggggcaacccaatcgccagcaggtaaaccaccagggttaacacgatcaggctcacaatggcggcaaagaaaaggatcacgccggttgccagccggtcacttttttgtgggttcatgctagccctccttattgcggttgaccaggcgcatggccaggttaaagaacagtgacatcactaacagtaccagggccagggaccacagggcgtcgttggccgcggtccccatgaccgtgttcccgatcccggtggtcaagaccgaggtcagggtggccgccgagctcatcaggctagttggcataatcgaggcgttcccgatcaccatttgcaccgccagggcttccccaaaggcgcgggccatcccgaagatcatcgccgtcaagactcccccggtcgcgctcggtaaaatggtccggtaaatggtctgccacctggtcgccccgaggccccgcgaggccatccggtaggattccggtaccgctagcagggtgtcgatcgtcatcgagaccatcgtcgggacgatcatcaagaacaagacgaccgtggccgctagcatcccaaacccggtgccgccaaaccactggcgcaagaccgggatgatcaccgtcaaaccgacgaacccgtatacaactgacgggatcccgaccaacagttcaatcaccggctgggtgaccttgcggaaggtggctggcaaaatttccgttaccgccaacgctaccatcagggataatggcagggctacgaccccggccatcatcgtcaccccaaaggaggttacaatcatcggtagggcgccgtaaaagcccttcttcggtgaccaatcggtgccggacaagaagtcccacacgttgaccccgtacttaaagaataaggacagccccttgctggctaaaaagaccaggatggtcaccaccagcaagccaatcacggtgatcgacagggtcgtcaacacccgccctagccgctcctgattggtttccttggaggaaccagttaatcgcttttcccaatcgttcattacttctctccaatctttgtgacgaccccgttagcatcccgttggaccttcatatcgtgaatcgagatgtagcgggcttctttgaccaagtgggattgaacatcgctggactgcaggtacttgatgtaatccaaggtcgcctttttggcgtgtttagtggtgtacatgtgctcataagaccacagtttccacttgttatcgctgatgttttcactggtggcgatgacgtggtcaatcgtcagggctttgacctggtcatttaaataggccgaggaaacgtaggaaatcgctccgggaacgttagaaacaatttgcttaaccgtcccgttggaatcttgttcctgggccttcatggtttcctgcccgtccatcaccacttgctcgaaggccagccgggtcccggaaccggaggcccggttgatgacggtgatcttttcgtccgggccaccgacctctttccagttagtaatcttaccagcaaaaatatcgcgcagctggctcatcgataggttgtccacccctaatttagggttcacaatcgggacaatcccggtcacggccacaatgtggtcaaccaacttgttggcgtcaatcccgttttgctgggcggcaaaaacgtcggagctcccgatgtcaacggcgccggcctgaacctgggataagccggtccccgagcccccaccctgaacggtgatgttaacgtccgggttggtcttattaaaaccagggatcgccgcttctgccaagggttgcaaggccgttgaacccacgtcagtcaccttggtgatggtggcgccattgccccgggcggaaaaccagccccaaccgagcaagagcaccaatatgaccccaaggcccccaatgatcttcttcattatcaaaatcctctcgtttggcttacaactatcaccctaggcggcaaatcggacgattttcccccgccgggtaagcaaggtgctataatgacaattgtaaacttttcttagtctaactctgggcgccttgcctaaccgtgccgggttacgcgacgcctcgggggctgacgggtgccggccatccgccctcgcatttctactataatttaacaaggccatgtaaaccttccaccttcatcgtgtaaagcttttgtaaattcaggggggaacgatcatcaaaaactttctgctcatgactaaggatcaaacctttgcgaccgatttagcccacttttgccaccaccagcactgggacctcaaccgggtcaccaccgctaccgccctggtggttaacctcgagcaaaactcctacaccggtattttgtgggacctggctgccaccaacttagacaccaccatcgccaccatgaccctgatccgccaccagcaaaacggcccgctgctggttttctcacccaacctcgatgaccggcagcgacgcaagcttttccgggccaaggtcgacgacgtattggaaaaagacctcgcccacgacgttttacgaccactaatcgaacaacgctgctggctttaccaacacgccacggtggccgatgaagacgccaccaccaatgatgatgacgatgaaccaatcattgaagaccggattaagatcggcgactgggaaatcgacccaaaaaaagtccgggtcaccaaggccggccaagaggttagcctgacccgcaaggaatttcaactcttagcctttttggccgaccaccagggccaagtcttgtcccgcgagcaactacttaacggggtttggggctacgatatcctggggagctcacgaatcgtggacatccacgtttcccacctccgcgacaaactggaggacgattcgcaaaatcccgtccacctaacgaccgtccgcggctttggctataaactggaataaaaaaacgctccccccagtggcgagcgttttttgtttggtttagtcttttccgtagagttccttataagcttcacttacttgttccattccctgcttacgttcttcaaccgagtaaccaatggcgttcggcgcccattcagcggcctcaccttccccatccgttccaaccaaaacgcatgacttataatcatctgcccagaccggcttaaaggtatgacccatgatcgtataggtcttgttcaacgcttcctgactaacgctagccgaattagaactggcgctactcgtcgaaccggccccatcccgttgctgggcgtgcatcgtcccagtggcgatcaactggtctaaggtgtccttgtactgcccgtattccttagccaactcggccttggtgtagttgacactggcgttcttctcccccatcccgttgctggtcgctgagtcgtaggcaaccaagacgtcgttgttattgacggtcatggtcgtgctgtgacccccgaagtcgactgaaaacttgttgtccttttggtaccagttcattctgtcggaattgctatgtaaattggccattccctgcccatcgagtttttcgtaggccatcagggcgtactcggcatccgtgtaggtttgatgttggctactgctggacgcgctgctcgttgaagtggcttttgacgtctggctagaactggtctgcgcctgcttagttgaacttgaagcactactcgtcttttggtgcccagacggcgtactcccacacgccgtcaatcccaatgcgaccaccgttagcgttcccaataagagtgtttttttcattctgattcctcccaaaaccaaactcctctgcgttttcctcccattctaactggtgatcgtttgattaacaagtagtctagtagacgattaggtctgggtctggttggtccaccataaagtcaaacagttcctcccagttcccgtcgacatctagttgttccaactgcttgaccagttcggccatcgccgggtcgtccttggctaacttgcggtacttttccaaccgcttcaagaattcggcccggcgtgcggccttggcaaagaggtcggcggtgacccgtttttgcgcttccttaatggtggccgaactaggcgtgaaggtggcaaaaacctccttaatcttaaaggaaaagcttgcctccggtttgtcgacgatttcaattaccacggccggcaaaatcttctcagcttcaccgtgcgcttgaaagggtactagcacccaatcgcccagcttgaggtcttcccccttatacatgggggtaaagccctggcgcgggaagtccttgagcccggcgccatcttgtttcagattagcgaccagcaagtcccggtagtcatcggcgtctgattgtagtgtcacttttactaacattttcaattcctcctttcactctctattattgcaaacgacctggacgtattttgtcgttaactaaaaaaatcgtggatttccacgatttttttcttagcgcttctttttcttcaggcgcttctttttattcttcttcatttgccgggccatccggttcatcgccaacttaccgaggcgaccgcctggcatctggccgcccatcaggttttccatcccactgaggttcccgttggtgacctggcgcatcatcttgcgcatttgattaaactgcttgatcatccggttgacttcaacgattggccgcccggacccggctgctaaccgccggcgccggcttgggttcatcatgtccgggttttcccgttcctcgggggtcatcgagtagataatcgccttgatgtgggcgaactgcttcgggtccaggttgatgttttgtaaggccgggttgttggccatccccggcatcattttcaagaggtcttccagcggtcccatcttagtgatctggtccatttggtccaagaagtcgttgaaatcaaaggaattttccttcatcttagccatcgcctgggtggcttgttcctggtcaaagttttcctgggccttttcgatcagggtcatcatgtcccccatccccaggatccgggaggccatccggtccggatggaagacgtccaagttgtccatcttttccccttcaccgacaaacttaattggcttaccggtgacggcccggatggacatggcggccccaccacgggtgtccccatccaacttggtcaagactaccccagtgatgtctaactggtcgtcaaacccttgggcagtattgacggcgttttgcccggtcatggcgtcgaccaccaggaggatttcgtctggcttagcgagttccttgatcttagccagttcttccatcagttgttcatcgatttgcaggcgcccggccgtatcgatgatcacgtagtcgttgtgcttttccttagcgacttccatcccctggcgcacgatttcgaccggatcgacgtcggtccccatttcaaagaccggcacgtcaatgctagcggccacttgttgcaactgggtaatggcggctggccggtaaacgtcggccgcaatgaagagtgggcgggcgttttcttcttttttaaggcgcttggccaacttaccggccgtcgtcgtcttcccggccccttgcagcccgaccatcatgatgacggtcgggatgtgggcggatttattgaggggtgttgccgtttcacccatcatttcggtcagttcatcgttaacgatcttgacgatttgctgagccggatttaagccctttaaaacctccgcgccggtagccttttcgcgcaccgtcttgacgaagtctttaacgaccttaaagttaacgtcggcttccagcagggcgagccggatttcacgcatcgtttcgcgtaaatcggcttcggtcaccttgggcttacgccgcagtttttccattgccttttgcaggcgttccgttaaaccttcaaatgccatgtgtttctcccctaataatttcaaattcgtgtggcaactttgccaaaaccatttctaattttactacacccgccccgttttctccatctaaacgagggggcggaaaattcacaaaaacaaaaccaggttgagagaaaaaccttctcctaacctggtcgctgttctaatcttttctactcaccaaacttacttcgcttccaggttctccatcccgtcaattaaatccctcagggtctgatcggtcgggtagtggcttaaaacgtaatcacggatccgatcggcctgctggttgcgggcttcaaactccgcgtacagatgtaacttttgctcgtagccctccaagatcttttcggtccgcttaatgttatcgtaaacggcctggcgcgataccgaaaactcggtggcaatttcgcccagcgagtaatcgtcggcgtagtaaagctgcaagtagtcgttttgcttggccgtcagcaagggttggtaaaaggcgaagagggcgttgatccgctcgtttttttcgagttccattaccaaatcctccttgctaatcgaccgtcacgagccccttgaagagcccgtaaacgaagtcttgggcgttgaattcttctaagtcgctcaccttttcacccaacccgacgaacttgaccggtaggtgtaattcgttacggatggctaagacgatccccccacgggcggtcccgtcgagcttagttaagacaatcccagtcacgtcggtcgtttccttgaataacttagcctgggtcagggcgttttgcccggtggtggcgtctaaaaccagcaggacttcgtgcggggcgtccggaatttcacgggttaaaattcgcttcatcttggccaactcgttcattaagttgaccttgttttgcaaccggccggccgtgtcgacaaagaggacgtcgtaattgtcctttttggccttggtcacggcgtcaaagaccaccgccgccgggtcgctattttccggcccggtgacgatgtcaaccccgtcgcgttgggcccacacttccaactgctcagtagccccggcccggaaggtatcggcagcggctaaaagcacccgcttaccctggcccttaaagcgggcggccatcttcccaatcgtggtcgtctttccggccccgttaacccccacgaacatgatcacggttggaccctgatcggccatcgtcagggtagtttgttccccagccccggcttcatcgtagaggtcgaccatcttttcgatgatcacgttggacacgtcttgcttgttcttggcgttttgcaaccggacctcttcgcgcagggaatcggagagcttcatcgccatttcgtaaccaacgtcggattcgatcaacatgtcttcgaggtcatcgaagaagtcttcatcgacgtggcggaagttcgccaggaaacggtttaaccgcgccccaaagccgttgcgtgacttttccagcccctggtcgtacttcttttccgtttcgtcttctgcggctggttccccttgtggcgccggctcgtcttctgcttggtcgtgatcctctttttggggttgctcaagttcttcttgggcctcaatcacctcggtcggtgaagccggggtagtgggctccggtttggcgatctggttgacccagtccgccgttaccggggccacggatgcggacgcggaatcgtcactaccttcttcagccacgtcactagcatcacttggcgctggttcctcactgacggccggttcttccgcaaccgcactagccaccaccgttggggccacttcttctaccggttcctctggtgcgacgctggctgacccttccgccgacgccggagcttcaacggcttgctctggtgtagcactaacagcttcatctttttcgggtgccacttccccttggtcgtcagctttgggagccgcggtttctgcgcccgcttcctctaccggcgccgcgctggtcgtctcttctttttctgatgctggctggtcaagtgtcgtagccgaactggcttctgctaccggtgcctggtcgacttcctcgcgcttcttgcgccgaaaaatatcaaataatcccatgtgatcccctcatttctatccttggtgctgtgctagggtggtgttgacgtcaacggaaaccatccgcgaaaccccggactcttgcatggtaaccccgtacaagacgtcggcgttcatcatggttcccttacggtgggtgataacaatgaactgcgggccctgatccccgaagcgatcgaggtagtgggcaaaacgatcaacgttaaccgcgtcaagggccgcttccggttcgtctaggatggcaaacggcaccggccggacctttaggatcgcaaataaaagggcgatcgccgttagggcccgttccccccctgataacagggatagacgctggttacgcttgccaggcggctgagccataatgtcaaccccggtcgtcagaggctgacttggttcggtcaggatcaacttggcctcgccaccgtcaaagatctgggtgaaggtttcactaaaggccgccgaaacttgcttgaaggtgttcataaagcgggtctcgacttgttgatccatttcggtcatcgtttgttcgagctgctctttggcggccaccaagtcagcttgctggccactcaagaagtcgtagcgctccttaacctgcttgtattcggcaatcgaagaggtgttgacctcccccaggtccgcgattccacggttcaagagcttgatttgacgagctagctcttcgtcggctaggtccgccatgtcctgactggcggcgtccaaggtcatctggtagcgttcgctcaggcggtttaagccctgatcaatcgtcgtttccagctgagcttgttcggcagccagcctggtttgatcacttaaggccaccttgagcaggtcctgcagtcgttgggcccgttcgctagcctgccgcaagtctgcttcgacttgatctaactggtcggtgacggtttcgacggcggcttggtggtccttgagagcggcgcgggattcttctaaggccacctggctggactcgtgttcggcgtccatcgtttggtcttgtttagataactgcgcgagcgccccttgcgtttccgctaaggcggcttggacctcgctttgttgcttcaacagctcactacggtgagattcgtcctgttccaagcgggtcttttcaacggccagccactggctgagctcgtgaacctgttcattttggctagcggcgttagattgcagggcggtcaactgctcttgcgcccggctgatccgctccttaacctcggccaactcttgttcaacccgggcggcctcgcaagctgcctcttgaacccggctttggtagttagcctgctggttgctttgttggttggtttggtattccagcgacgtcaccgtttgggcggcggccgttacctggtcttgaagccgctgggcctggttactctgctccacggcctcattacgtgcccgtgctagttcttgttccagcttgtcgcgggtgacctggctggcctgacgcgcccgttggaggcgctgaacctgtgcttccaactgactggcggtggcctgagcctgtttaacggcttgctctagctcggccaactcttggcgttggcgaagtagccccgtccgctggttacggttggcccccccggtcatggccccagaggcgttgatcagttggccgtctaaggtgaccacccgaacctggtgctgcccggcccgggcaatctcagtagcgtgatcgaggttgtcaacgaccaccgtgctggccaggagctggtcgaccacgacttgaaaacgagcgtcataggctatcagctccccggcccggcccacgtaacctggcatggtcactaacttggctaagttgcggggggcaaaaccgccacgtaggttatccagtggcaggatcgttacccgcccgccccggctttggatcaaatcctgaatgatccgcttcccggtcgcctggctgtcaacgactaactgttgtagttgcccacccaggacggtttcaatcgccgtcgtatattgacttggcacctccaggagttcgctaacggcgccgaaaaggcccgggtaggcctggcgcttacgcaacacctgttgaaccccgtggtagtatccggtgtaatcggccgccattgattggtaacttttaatccgtccctcggcggaagaaacgtcccccagggcttggtaccaccggcgggaagtctgttcgtattcctgctggagtttggcttggctggcctgctcctggttatagcgctgtaccaactcttgggccgtttgctcagccgtttgggcaacggtggcctgttggttagccgctttcgttagctcggccaacttccgcttggcttcactgagggcggcggccccggcttcttgttggctctggttacgctggtgatcccgctttaagaagagttggttgttttgaatcgtcgtttgttcctgcatcaagtcgacttgcttgttgcgcaggttttcaatcgtctcctctagctgggcggcccgctcttcggcgctcatcgtctttaattgacgcagctgagcctggtggtccttgatggcttccttacgcttagtcagttcgccattgaccgccgttatttggtccgtcagcgcccgttgttgttccgtcaggtcgctttgccgcttggtcaaccggtcctgttcggcctggcgctgttccttgcgaaccgaggagagcgactgttgattttcgagtttagcgatcacctgggtcgcctctagcaacttagcctggtgctcatcgcgcgtcgccagtaattggcgccgttgtccctctagctgcgcctggcgctgactagcggtgttggcgtcctgatcgtattgcttagttagctctcggcccttgacgaccttttcgttaacctggcttagccgggcttggttagccctggtttggcggaccgtttgggtacgatccaggcggtccaggcgtgccttttgctctaggtactcctcggccagggtgctttcctcggctaacggggccaagcgcccgttgatttcggcaatgatatcgttgacccggttaaggttatcagtggtggtaactagccgtttttcggcggtccgtttgttttgcttatacttggcaacgccggctaccgtttcgatcacttcccgccggtcggttggcttcccgttgaaaatggcggctacccgcccctgggagatgattgaaaaggactcgcgcccaatccctgaatcaatgaagaggtcgacgatgtctttgagccgtaccggccggtcgttgactaggtactcggaatcaccgttccggtacagccggcgggtcaccgttaattcggtaaactcggaatccaagtagtggtcgctgttatcgagggtgatcttaacctgcgcccggtttaagggcttgcggtcggccgccccgttgaaaatcacgtcggccatcttatccccccgcagggtcttggcggactgctctcccatcacccagcggatggcttcaataatgttactcttcccgctcccgttgggcccaatgattccggtcatccccggtcgaaaatcgataacggtcttgtcggcaaaggatttaaaaccttcaatttctagtgaaagtagtcgcatgagtgatcaacacctacttgtccattcgtagtttttctaaggcgtgtttagcagcgtccatttccgcgtgcttcttggaacttccctggccggtggcaacctttttaccgtcaacggttacttccacttcaaagaccgggtcgttttccgttcccccttcgcttaggaggtcgtattcgattgccacgtcaccgtttctttgcaggaattcctgcaggctggtcttggcatcgacggcgtgatcgaaccaccccaggtcaagcttagggaagataacggtttgaataaactgttcgaccgcttggcgtccctggtctaggtacagagccccaataaaggattcgaaaatatcgcacagaaggctagcccggttacgcgccccggccatttcctcccccttacccaggcggatgtactggtcaaagtggcactccttggcaaacttagaaaaggagtcctcgcaaaccatggcggcccgcagccgggttaatttcccctggggcagttccggatagcggcggtagatgtattcggagacgaagagctgtaacaccgcgtcccccaaaaattcaattcgttcgtagtactttaggttctcgtgcgggtgctcgttgacgtatgaggcctgggtaaaggcttcggccaacagcgccgggtcattaaagtgaatcccgtaggttttggctaggtaatcctgcaattgtgtaatcatcgtgtccgtcctttctgatcgggcctctgatagggggtcgtgagcccacgaccccttatcacagaccgaatacccatctatttggtccgttttgcaaaaaaaggccgcgatatgttttcgcgacccccttttttagcgtaccagcgttagtccttttggtgggcggcgatgtaatcaaccacttcaccaatggtactgagtttttcagcttcactgtcctcaatttccgcgccgaaggtgtcttcgacctcgagaacaaactccacaaagtcaatggaatccgcgttcaggtcggtcttcaaattcaggtcatcggtgatcttggcccgatcgacatcaaagtggtcggccacgattgacgagaccgtatcaaagatttccttcttatccattctttcaatacctcttttatctaaactaactaccttattctattagtttttgcttggcttgtctatgttttcctcagattggacctgaccaaagtaggagaccgttttttcgattaccttgctttcgatcatcgtgtggatttgggcgatcgtgttttcaaccgctaaggcatcagccgaaccgtgggttttaactaccggcgctttgagccccaataagacggcgcccccataggttgacgtccccatcaacttggcaatctttttgaaaaccggctttaagaacaggtagcccagcttggcccgcagcccaccgttttcgatcccgtttttaattaaggtcaacatcatcttggcggtcccttcggtagccttcaaagcggcattggccgtccacccatctgagacaattacgtcggcttccccagccaagagggcgctcgcttccacgttgcccacgaagtttagatccccttgggccttaagttgttggtgaacttccttgtggaggcggtcccccttatcttcttcggtcccgttattcaacagggcaatccgcgggttgttgacccctaagacgttttcggcgtaaaagcgccccagttgggcaaactggagcaagtttttttccttactttcggcgttggcaccggaatcgaggtaaacaaagttctttgccccactgcctggtttggcaattggcaggatcgaagtcaaccccggccggtcgattcccttgattcggccaacgatgaataacccggccgctaaaatggccccggtgttgccggccgaaaagaaggcgtcggcttggccttccttaacggcgacggccgcccggacgatcgaagaatcctttttcttgcggatggcccgcaccggttcttcacccatctcaatcatttccgtcgtttcgatcaaattaatccgggtggcgtccttaatgaggggccgaacctgctggggatccccgaacaggtcgaattcaatgtctttaaaacggtcccgggcccgttccaccccttccactacaacggctggggcgttgtctccgcccatggcatcaactgcaatcttcataactcttctctcctaatcaaagtgtgtttctaactggtgacgctgtaagtacaacaccagtggctggttttcatccttttgatcccatcccggggtagccaggaggttgccggcgtctgcccgagcgatttgaagcatcttgaggtcgcccaccgggtcacccaccttaaaatcgggcatcccggactggcggtcccccagtacgtccccggccccgcgcaactcgaggtccttttgggccacttcaaagccatcagtggtggcgaccatagtttccatccgcgccttcccctcgtcggttttagggtcggccactaataagcagtaggattgccgcttgccccggccgacccgtccccgtaactggtggagctgggccaggccaaagcggtcggcgtcgtaaatcaacatcacggtggcgttggggttgtcgaccccgacttcgatcaccgtagtggcgaccatcacttgcaccttgcccgcttgaaagtccttcatgaccaccgctttttcgtcgttattcatccggccgtgcaagagccccacttggtaggtaggaccaaagtgttccttaaacctagcgtagaggtcggtagcgtttttgacatccaagttttccgattcttcaattaagggcgacacaacgtaggcttgggcgccggcccttagttgctgatccaaaaagtccagggcactttgcccctggtttcccttgagccaagtggttttaatcggttggcgcccggccggtaattcgtcgatcaccgagacgtccatttccccgtaggccgtaatggctagggtccgcgggattggcgtcgccgtcatcgctaagacgtcggggtgctcccctttttcacgcaactgctggcgttggttgaccccaaagcggtgctgttcgtcaatgattaccaaaccgaggttggcgtaatcaaccccgttttgaatcagggcgtgggtgccgacgattaaattgacgtcaccggccttgatggccttggccagttggtcatgttgcttagcggttaaagccccggtcaacagggcgacctcaacgtgggtaccggaaaagaccttcgccaacttttcggcgtgctgggcggccaggatttcggtgggggccatcagggccacctggtagccggccaggacggccgccatgaccgcaatcgccgctacaatcgttttcccggacccgacgtccccttgcaaaagccggttcatttggtaaggggcccgcaagtcgcggcagatttcattgaccacccgcttttgggccgccgtcaactcaaaggggatcgttttgataaagtcccgtaattccgcgttatcatagaggatctggagcccctcttccttgcggttcgcccgtcggatcgcttgcaagcgtaactcaaacaagaaaaattcctcaaaggcggccgttcgtttggcggcttcagccatcgtggtgtcggtggggaagtgcatctgcttgatcatctcgcgccgttccatcagctggtagcgttgacgcaggctaattggcaggagggtcgcgatcacgttttggtactgatcaaaggcctgccggatcagtttccgtagggtggcctggcgaacgtgcttattggccgggtaggtggccccgactgcctcggccttactgtcggcagcgactaatttggtgcccagaatttgctggcggggggcgtcccaggtccccagtaccgtgacgtcgtggttgggctcaacttgttgctttaagtagggttggttgaagtacaccacgttgaccaccccggcttgcccaaccaccaaacgaaaggacatcctggagcgccggtagccgtaccgtgacatcagcggctcagaaaccaccgtccccttaacggttaccttttgcttgtccttagccacggttaaatcagtgggggcaaagtcatcgtagcgtgacgggtagtgggttaacaaatcccccaccgttttgatccctagcgtggctaggttctccaccgtcttgggccccacacccttcaattgaccaactgaatcctgtagcgaccgcacgcttgcacccccttaaacactagaagcggggttgccgcgtggaccaccccgcttttgcggttagctattcaactgagatcaggtatgggtaaactggctgatccccttcgtaaatttgtacttcgacttcgtcatcgacgtcttcgatcgccttggaaatccgttcagcggcttccttggttccatcctgaccgtaaaggatggtgacaatttcactgtcctcatctaacatgccaaccaccatttggacggcggcgtcttcaatttccggcgccgtgttggtgatcttgccgtcaacgatccccatgtagtcgccttccttgatcgtttggccttcgatcgtcgtgtcgcgaacggccacggtgacttccccggatttcacgttagctaagttcgcttccatcgccgtttggttagcttccaaggtggcctctgggttgtattcaagtaaggaactcatcccctgggcaatcgtcttggcatgcacgaccttggttggaatgttagccacctgggcagcttgatcggcggccatgaagatattaccgttatttggcaagatgatggcctgtttagcccctgattcattaacggccttaaccaagtcttcgatacttgggttcatggtttgcccaccgctgatcacgtgggtcaccccgagggacttgaacagttcttggatcccgttaccagaggccaccgcgatcaccgccgtttcaaattgcggttggtcggccggcttggcagctggtgccgactgctgtgcgggctcttgatcgtgttccatgatcgattcttgttgccaacgcatgttatcgatcttgatcgtttgcaggtccccaaactgaagtccccagcctaaaaccttatccggttgctcggtgtggacgtgaaccttgacgatttcgtcgtcattgattaccaggagtgaatcacctaggtcggctaagtagttgtagaaggtgtcgtaatcaaacttcttggtaaccgtcttaccacggccaatccgcaccatcatctgggtgcagtaaccatacttgatgtcttcggggttgagcttcccttgtgcactctgacggtggttaacgttaaccatttcatctagggtggcggcatccggcagggtgtcttcgactacttggccagtcaaagcctctaaaaagccgtgcagcaccgttaccagaccctgaccaccggagtcaaccacaccgacttcctttaataccggtaagagctccggcgtcttttggagggccaagtcggcagcggtaacgatttcttgcagcacaattgctaaatcgtcttcgccgtttttgactacgttcaaccccgcttgggccgactcgcggactaccgtcaggatcgtcccctcggttggcttcatgacggccttgtacgccgtctttgccccgttagcgtaggcatccacgaaggccttagcgtcgaggctttcggccccttcacagcccttggcaaagccacggaagatttgggataaaattaccccggagttcccccgggcccccatcaacagccccttagccagggcgttagctaggtcaccaacggccgtggccgtggcgtcccgttcgtacttggccccggaggccattgacattgacatattcgtcccagtatcgccgtccggaactggaaagacatttagcgagttgatgtaatccgcttgggccgtcagcttggcggccgcggcttgcaccatcttgccaaattcatggtttgtaattgttgtaactaccaaagttattgttcctcccgctcggtcacgctagtcgcccaggacgcgcacgccctgaaccataatgttcacagagttggccgttaccccgagcattgcctctaagttgtacttcaccttttcttgcacgctcttggagacggcggaaatcttggttccgtagccgacgataatgtacacatcgacggcaatcccgttatcctgttgacgaatgacaacgccctggtggaagctatcacgtcctaagatttggttaaccccatcctttagcgggttgcgacttgccattccgacaactccatagttatcggtggcggcgccgccaacaaccgtcgcgatgacgtcatttgcaatgtcgatcattccagcaggagttttaatctttactgccatccaaaacggcctcctttagtcgttgaactcagttcgtaaaatttgtatccatcatatcttaccatacaacgccccgggcaacaaaactaacccgttggcaagcaaaaaacggctgccaaaaattggcagccgcatttgttaggttcttagttaacccgagtcactttccctgacttcagggtacgtgctgaaacgtaaaccttcttcggcttaccattaactaaaatggtggccttttgcaagtttggcttccagctgcgacgacttgagttaagggcgtgtgaacgcttgttaccaaactgcgtccgcttgccagtaataaaatccttagccatgataaccctcctctcctcatcaaattattttctccgcgcatctgcggtaactcacctaaataatttaccataggggtgcggtgattgcaacattttctttcaagtatttttccttgacagctaacgggcaccccaatcccggctctgaatgacggcaaccaccccatcttgaaaggaaaagtggttaacctcaccaacaaactcgttgctggaccacgaaatgggcacctcggcatcaaaattagtgagccggtacttttcatctggcagggttaggcccttgacgggggttaaattgacgaaggccaagtacttcatctccggtaacttctcaattgtatactcacccggccagtagtaagtgacttcgttttgccggtcaattaagcggagccggtccaagtagggctgaaattcctctaatagcgggaaatagaggttagacaaaagctgatccaagcgccccccggtggccccgtatatgttaacccgatcaggctggtagtctaaaaaggcccgcttgacccctaattgggtgtcggtgtggtccttttcgggggggaacgtcgttaaagaaattccccgctcctctagccgttgcaagaggggcgccggcgttgaatcaaaatcacccagtgccacttgtggtgtgattccgtggtccaacaagaaggtggcgccgtaatcaaccccgatccaaatctggttggcccgcgtccttagttggtctagcggcacgagctctaggatccccccgaccatgatgttgacttctctcacgaccttacctccccatcaaaaaagggcgtgacggaaatcagtgatttcgctgtcacgtccctaagcgttacttcgttgcgtccttgatcttgttgatttgggccactggatcttcgttgtcaaacacaaaggagccagctacggccaccgttgcccccgccttgtagcagtcaacaacggtttggtcgttcaccccaccatcgatttcgatgtcgaagtcgtaacccagttccttcttcaaagcatccaattcggcaatcttagccaccgtttccggcaggaacttctggccaccaaagcctgggttaacagtcatcaccagcacttggtccaccatgtgtaacacaggcttgatcatgtcaaccggtgttcccgggttaataactacttcggccttgaccccaccattcttgatgatttgaagggcccggtgaatgtgttgggtggcttcgacttgcaccccaatgatgtcggcaccggcgtcaatgaagtccggtaaaatgtgttctgggttttgaaccatcaggtgcacgtctaagaccatcttagagattggccgaatcgcctttacgaagcctggaccgtaagaaatgcttgggacaaaactcccgtccatcacgtcgatgtgaaggaattcggcgccacccttttccaccatttcaatgtctttttgcaggttcacgtaatcagcactcaaaattgacggtgcaactttaatcataatcaattccctcatttctgatagtttggtttctggttggcaattaactcgtggaactggaggtaattgtcataccgactgttcattattttaccatatttaagcgcattcttaaccgcacaggacggttcttttatgtgtaaacaaccccgaaatttgcattcgggcgcgagtgcttgcatctccgggaagaagtggggtaactcctcgacggtcatttggaagtcttcgtacgacgaaaaacctggtgtatcagcaatcaaggcgtcgcccacctgcatcaagctaaccttacgggtggtgtgacgcccccgcttgagggcctgggaaatctccccggtcgccaggttaagatcgggcgccaggtggtttaacagggtggacttccccgccccggtctggcccatcatggttaccaccttaccggccagtatcttacgtaactcacctaaggcctcctcaccaaacgggggccgttggtaaagcaccgggtagccaatcatttggtagccttttaccaccggcatcagggcgcctgcttcttgatccgacaggaggtccgttttagagaagtaaatcaccggatcaatcccctggctctccaaggccactagttggcggtctaataggttcgttgacaggttgggttccttaacggcagtcacgaccaccgctaggtcgacgttggccaccatgggacggaccaactgattcttgcggggcaagatctttaggaggtagccctcccgttggttttccgcctcaaactccacttggtcaccaacgacgggctttaacccccgcttccgaaagtttccccgtgccctggtccggtataattttcccccggaccaaatgtcataaaagccactcagtgactgctgaatcgtcccgtttttcacaaacgacctcctatcgcttttagccggtaatgttcgttgcactcatgatcgtcttgccgtttcggatcaccttgtaggccccggtttgaccgttgcgcagggtgaacggcacgttgatcgttgtttcctggttaatcgtgatgtcttggtattccatcgttaggttgtggtaagcatcctcaatgtaaacttggacccggttttcggtcttgcccccgttaccatcaaaggggatgtcgatttggatgctagtggttttcagttgggtccccgaacttgcaatcaccaccgtcagggtgtcccccttagctaaacgactccccgccttgggagtttggctaatgaccttgttggccgctaccgtggttgattcctgttgggtcaccgtcagttgtatgccatgcttgctagcgtagtcttgaacgtcggtaatgtcctcgtttttaaagttaggaatcttataagtttgtttcccggccgatacggttagggtaatcacgtcttgggccgggtgaaccaccgttcccgagctcaccgattgacgaatgatttgccctgcgctaacggaagaggaatactcctttttaatccgtacggtaaatcctttggcccgtaagctttcggcggtcccttggtagtcgttgccgaccaggtcgtccattgtccacttcttcatcccgttggataagatgacgttcacttcacgaccataacgggccttactggcaccatcaacggcgacaatccgatttttggccactgacgaggatgtttcccgggttatatttcccaagcgcaggtgctttttagctaacgccttggtcgcctgagcggtcgtcatcccggtcaggtccggcacggttacttcacggttgaaataccaccccgaacccagtagacctgctaaaacaatcgtcagtaggctcacccacaacccccggcgccgtttctttttcgggacgggcggctgttctggagccgtctcttgttgttcaggggcttcttttgcttccggctcctgcttagttttggccgccgcttccttgatttggcggtaatccaagaccttagtttcctcatcccctgggtctgctaagaccagtggtgcctcgttggctcgctccggagtcaggaccgttttcaagtccttggccatctcttcggcggaaccatagcgctgggcggggtccttggcggtcgcccggtagacgacgttttccagtgactggggaatcgccgggttcgcctggcgtaccgaaggaacccggtcccgaaagtgctttagcgcaattgaaaccgcggtttccccttcaaagggcaccttgccaactaataactcgtacaggataatcccgagtgagtagatgtccgaacgcttggtggcaatcgagccccgcgcttgttcgggcgataagtaatggaccgaacctaacagggtattcgtctgggttaacgaattccccgagctggccgtcgcaataccaaagtcagtaattttaatgttttgttgatcgtcaattaagatattttggggcttgagatcacggtgaataattccctgggcgtgggccgcttcaacggcagccagcacctgttccataatgttaaccacttgggggagcggaagggggtagtgctgcttaatgtacgccttgaggtccatccccttgacgtattgcattaccatgtattgcattccgtggtcttctcccacgtcgtaaaccccaacaatgtggggatcattaagttgggttgccgctaaagcctcgcggtgaaagcggcgctgcgtgttgggatcatcccgcagatcaagccgtaataatttaaccgatacatcccggtctaaaaccaggtcgtgggccaagtagacattggccattccgccctcaccaaggggacggatgatccggtaccggtgatttagctcgtatccgggttccatctgttatttctcctggtcgttttggctaattaaaacggtgacgttatcgttgccgccggccgcgttggccagcttgatcaggtcggcacacttatcttctaaagactcgtgtcccgctaaaacggccgcaatctgatcaccttcgaccattttgctcaggccatccgtacacaacagtagttgatcattttccccgagttcaaaggaattgacgtcgatttcagcgtcagttgagattccaattgcccgggtaataatgttattttgcggggaatgtgcggcctcttgttccgttaagtcaccgtttttgactagttcattgacgagggagtgatcgacggtgatttgggtcaataaatcctggtggaaaatataaccccggctgtcaccaatattggcgaccacggcaacgttatcaatcaggattgccgcaaccatcgtcgttcccatccctcggtagttaagatttgaatttgctttatttaaaattaatttgttaaccaagcggaccttatcccgaaaccacgccttagcggtgcggacggttttaggtgcctcctgggtgaagtaacgaccgagcgccgctaccgtttcttcagcagcgacgttgcccccattattgccccccactccatcagcgataaccactaattggaggtttggcgcagcaaaaaaattattaacccggtcctgattttcggaccgttgttgaccgatatctgattgaaatgcagtctccatgagtttctttttccccttctactgaactcgttgaaggttactaataaagaaaccatcagagccgtagtcactcggcaacagggtgagcgtctgggcttggcggttgtccttcaacatacgtgcggtggtggttttttgtaaccggaagttggggtggtgctttaaaaattcggccaccgtctcgtcattttcctgacgaaggatcgtgcacgtactataggtaattataccgccctttttgacttttgtggccaccgaatccaaaattgccccctgaatttggtggagacgttggctgtcgcccagttgcttatcgtagcgaatctccggtttccgccgtaaaagtcccatccccgaacacggtgcatcaaccaagatctgatcaaagaactgatcggcaaattcctggccaacctggcgagcgtcgagttggcgggcgaagacccggtcgtcaacccccatccgttgcgcgttcttttcgattaagcccaccttatgccggtggatgtctaaggcgtagacctccccgtcagttaaggcctccgcaatttgaacggttttaccccccggagcggcacaggcgtccaagacccgttcgtgaccggtcaggtgcatgctttccacggctaacatggcggattcgtcttgaatcgttaccaccccgtttttaaaggccgccgtttttaacaccgcccccttagtaaccactaagccattttgggcgacctcagatggtttggtttccacccccgctgaccttagcagtgcttgggcttcttcgaccgtggccttggcccggttaacccgtaggctgatccgtgccggttcgttaattaccttagcaagcgcctccgtttgggccagcccatactgagcgaccaattcgtcaaccagccagtccggcagggaggcttggatggccaaccgctgcttggggtcctcaattttttcaacgtcggccactccgttcctcagaattgcgtgcaaaaccccggtcacaaagcgacgaaccccagggttcccccgccgcttagcaatttcgatcgcctcatcggtagcggcaaagtttggtacccgatccaggtactggtactgaaagagggtcattaacaaaagggttttgacccaagggcgcacctttttgccggcgataaagggggaaagccagtagtctaaggtccgttggtgctgtagagttccgtacactaaggctgttactaggcggcgatcagcgcccgataattgcccgctttctaaggcctggttcaactggagatttgaataggcccccgacgtgcggaccttatctagcgtcgccagggcgatggcccgggcccccgttaattgtgcttgtttcttagtcattgttaatcgcttgtactcccggctttaaattttggtggccgtttaagtaatccgtaatgtccatcttgggctttccggctggcttaaggctgttaatctggtaagtcgtccccgctccggccgctataatcagggcgtgtttttccacccgcaccacctggcccggttgcagatcagtcgtttccgttagcggggtcacgtcgtaaaccttagttcgtaggccatcaatcaccatgttaccaaccggggctgggcgcaacccccgaacgaggtcatcaattcggtcggccgggagcgtgaaatcaatcgtttcttgttcgcgggtgatgtttggtgaaaagacaacctggctttcgtcttgtttgaccggggtgatatcgccggcgagcaacttaggcagggtatctaacaaaaggtcgcgccccagtagtgatagcttttcaaacatcgtcccggtatcgtcttgcttggtaattggtaaactagcctggctgatgatatcgccggcgtccatcttcttaaccatgtacatgattgtgaccccggtctcggcgtccccgttcatcacggcgtattgaattggcgccccaccccggtacttaggtaacaaggaaccgtgaacgttaatggccgcaaccttagcggcggcgagtagcttgtccggcaagaattgaccaaaggccgccgtgataatcaggtccggtgctagttcaatcacccggtccatttcggggctgtgattaattttttcgggggtcaaaacctcaattccgttttcaagggctagttccttaaccggagtggcccgtaattcgcgcttgcgtcccacccgacgatcaggttgggaaacaacggctagtacttggtagtcttcgctatcgatgagggccttcaaaattgggaccgcaaactggggggtccccataaaaacaattgatttcattggcgtggtttcctttctacatctacaagaagtactggggatccgggtcaatcatcacctgggtctcccggtcaaactgttgctgggccccttccatgatcgcggttaagcgggcatggagggccggatcgtgacggtacttgatcacaatttggtaatagtaacggtttttcaagcgggcaattgcccggggggtggggcctaaaatgatcgtttgcgaatccaactgccccaccaactcctggcgaaccgcttgcatcacccgggcggccatctgctcatcggggtggctgcccatcacccggaccgtgtaataatacggcgggtaggcgccgagtttgcgcaggttcatctcctggacgaagaagcgctcgtaatcgtgggcccgcgccagttggatcacgtaattatccgggttgaaggtttgaatcaccacttggccggcctcatcggcacgtccggcccgcccggccacctgcgctaggaggtcaaaggtgcgctcagaggaccgaaaatcgggtaaatccagccccgtgtcggcgtttaagacccccaccagggtcacccccgggaaatctaaccccttggcgatcatttgggtccccaataggatgtcggcctcgtggttaccaaacttagttagtaatttctcgtgcatcccctttcggcgggtagtatcaacgtccatccggatgatccgagcggtcggcaggtaggtttgcaattcggctaccgccttttcggtaccggtcccgtagtagcggattcggtggccctggcagttcggacaggtgttggggatccgctcctcgtgaccgcaatagtgacactttaggctccggctatccatgtgcagggtcaacgagatatcgcagttgggacacttaggaacgtaaccgcagtccctacacatcacaaaggaggaaaagccccgccggttaagcattaggatgctttgctgccccttattaagccggtcggtcaacaagttcaagagcggcaacgaataattagtctccccccgcgcttgaacctctcttttcatatcgaccacttggatcggcggcagggggcgttggttaacccggtggagcaaggttaagcggtggtataacccggtcgccgccctggcccggctttctaggctcggggttgccgatcccaagacgagcggggcgtgatggtaagcagctcgccacttagcaacgtcgcgggcgtgataacggggggcgtcgtcttgtttgtaagacgactcgtgctcctcatccataatgatcaaaccaacgttgtctaggggggcaaataccgctgagcgcgcccccaccaccactttcgcctcgccacgcttgattcggcgccattcgtcatagcgttccccgttggaaaggcccgaatgcaggaccgcgacttgtttaccaaagcggccccgcacccggctgacgatttgcggggttagtgaaatttctggcaccaacatcagggcgctgcgcccgttagctaaggcccgttcaattgcccgcaggtaaacctccgttttccccgaacccgtcaccccctgcaacaggaaagtttcggcggttcgttgatcggtggcctggttaatccttttcaccgcctgggcctgctcctgatttagggtcggcggggcagttggtgacgtaggcagcgccccactgggatcgcggtaaacttctgcttgcccctttttgagccacccccgcttagccccggtcgtaaaggtagccgccgaaaggccactctcttcttgggcttgcttgagtggcacggttttccccgctaagctttgcaagtaatccaatagattccgctgggcgtgggcgttttttaacacccctagtcgctccccttcgtaatcatcaaaggacagcgttggggtaatggtggtgatttgtttagcccgggcccggttgtgaacccgatagtcaattaccaccttacccgctcgccgtagcctcatcaactgactcagtgccaggggatcagtttgaactttggcaagatctaattcatcctgatcggcaaacagggcgagcctcgtttgctcatcaacttcatcgaccaagcgaaccaaccgtgtcgtctgggcctttaagaggctcggtaacatggtataaaaggccgtgattttaaaggcgtaggtttgatcggccaaccaacccgctagtttcagtagctcgtcatttaagaccgggcttaggtccatcaccccagcgaggtcctttaagtcaccatcaaattcatctggttggtcaacggcgaccacaaacccttggacctcccggcttccccgcccaaaggggaccatcactcgcatccccggttgcacttgacgctcgaggcgttcgggcacccggtaggtgtaggggcggttggtctgcatcgttggaacatcaactatgacttgaacgagttccgccatttgttttcccccccaatcgttgaccaatcagcgctaccagtcgctttgccaccgccgctttactaagcttgggccaagtctggggtgcctgatcggccgctaaaatggtgacctggttggtatcggccccaaagccactgcccaccttggtcacgtcattagctacgatcaaatcggcgtttttcttctttaactccgccatgccgttttcgaccagggcggttgtttcggcggcaaaccccaccaccaggcggtgccccttcttttgccccattgtcttcaaaatatccggggtcttcaccagtttcaggatcagctccccgtgggcatcctttttgatcttttggtcactgactgcttccatgcgaaagtcggccaccgccgccgccattacgagggcgtccgccccttcaaaagcctgatcaacggccgccaacaactcctcggtggtttcaacttggcgaacagtgattccggcgtcgtttggcaagtcgacactcacgctgccaacaatcaattccacctgggccccctggttagcagctgcttttgcaatcgcaattcccatcttaccggaggaacggttgccgataaagcgaaccggatccagtggctcgcgggttccccccgccgtcaccaccaagcgcttacccgctaaggcgtttccggtggttaaaaactccgcaacccaagcgataatggtgctaacctcgggcatccgtcccatgccggtgtaaccctccgccaacatcccatcggcgggttccaagaagtgaaccccatcagccagcagttgggtaacgtttcgttgcgtagctgggttttgccacatgtgtgaattcatggccggcaccaccagacgcggggcctgggtcgctaacagggcgctggtgaccgcatcatcagccagccccgccgccatcttagcaattacatccgcactagccggcaccaccaaggccaagtcggaccagtcggctaagtgaacgtgagggatttgcccctcttcgctcatttcccagaggtcatcaacgaccgggtggtgcgtcaaagaagccagggtggcgggaccaacaaactgctccgccgcttttgtttgggccacccgcacctcgtgaccagcgcgctgaagctcccgcaccacgcttactgccttataagccgcaatgcttcccgttaggtataccgcaatccttgccatcctgtcttcctccttaaaataaaaagcgacccgggatccccctggccacttttcccggttcacccggtcattaatcttgtaagtcttcgtgttggtcggggtcgatcgttaccaatcccgcttcgatttcttccagcgccatcccaacggacttgttggagtcatagtggtccaacaagagcggcttgtcgccttctaagctgaccgtttcgccagccttatccgggtgggccgcccgccacttatcgatccggtacttgtcgatttcgtgggcccgcttgctagccaacatgattagtgagtaacgggagtcaacccgctctaatagcttatcaacggatggaaataagatcatttcatcgattctcctaacatttctaagtagtccggcatcacgcgccgcacccgtaaccgttcgctacggatgatttctttaactttttcaacggcgtttggaacctcgtcgttaaccaccgcatagtcgtaattttgcatcatttcgatctcactaaaggccttcttgatgcgcttgttaattacttccatgctgtcggttccccggtgaattagacgttgctttaattccattagatcaggtggggttaggaaaatgaagacgccgtttgggctcttggaacgaacttgcatcgccccgttaacttcaatttccaaaaagacgtctttaccggcatctaaggtatcattaatccattttaatggcgtgccgtaataattgtcaacatacttggcgtactcaagcatttcgccggcctggattttttgttcaaactcctctttggaaacaaagaagtagtccttgccattgacttctcccggccgcggcttgcgcgtcgtcattgaaattgaatactgaaagtcgtttcccggttggtcaaagatggctttacgcaccgttcccttaccaactccggatggtcccgaaaggacaatcaacattcctcgctttgtcatgtttgctcttacccctaaccttttttaaaagtattggatatatgataccacactttgcccacctgccggggcgtcaatggcgaattctcgccaccattttataaaccccggaatgtcaactcaagcgcaacaccatggagccagaccgtgagctagcttgctagcgcggcctcaataagctcggcggcgttagcgtagccgagtgtcctgcgatgtttttgattcagcgcatcttgaacctttgcgatatcatcttcagagaagccatgtagtgataggcctttagggatgtactctcggatcaggccattctggttttcattactgccacgttcccaaggcgagtacgggtgcgcaaagtagatctgagctccttgaacctggtccaacagtttgaactcagagccgttatcgaaagtgatggtcttaaagtagccaggatgctggtcaatggtggcttgaagctcttttaagcaggtgtctgcgtggtagttgggaatcttgacgatgatctcatagcggactcgccgttcggtcagggtcatcagtgctggttcactggcttgacgcttgcctttaaccaggtcaccttcccaatcaccaaagcgttcacggttattaatagtgtctggtcgttcatcaatcgaagtaccagccagacgcttatttttacgcgagtggttgtgacgattggactttacatggcgccgcagcttggctggcaggtcgatattcttaatgtctaagcggccttgatcaatataccgataaacggtcggcgttgaagggcacggctggtcaggatgagtctgcttaaaggcgtgcacgaaaccatcaacactatcaatccgtggtcgccgtttaagcgctgttttaagcatcttaaagaacaaccagcagaccttttctagtccgccaaaacggcagttctgacgcgctttatcatgaataagctggctcgtgtccgcaaagtatttggtgaaaaagagatagtcagaattacgttgtcgaatggtgccacgcttaatttcacgcgagatcgtgctgcgactgcgattggtcaggcgcgcaatatcagcctgagattttccagcattcaagtacgcttcaatttcacctctttcttccggggtaagttgttgataatgtttggtagtgctatgcttggattgggtcatggagatgtcctttctttagagtttcagcactttaagtttaggtctccatggcctatttgtataatttgaacttgttgcacttagattttaaatccgggaccattttataaatacgaacaaatgatcgattttgcccttgcctttttgaacgtccgttcgtataatatagtcacaaacaaacgttcggagggaagcacgatgcaaattcaaaagcgttctttaattaaccgggggaccgccctttggtcttctttatttgaaacccctcagcaagcccaaccagtggaaccacgggttcttcccgttcaacccctctttcagcggcggcaattcctcgcccgggccattgaggagcaccgggaggtcttcgttcaactaatgccggtccacaccgatggtcaaatcaccaacgttcgcggtcacttatcccaactccgtgtcggtcaatacgtcatccaaaccggtaacctttcttacttctttgaactcccccagcttcgctacatcgcaggctagatttttacctatacaagaatacaaaaacggctaagagaaaccctactttctctcagccgtttttttgttcacaccaaggagaacggtcccgttagtcctgggccttttgcttagccatcgttaacaattccgacgcgtgctcgcgagcaagcttggtgatcgtatcacccgccagcatccgggccaactcttcaacccgttggttagtgtttaacggcgttacgctagtcgtggtccgttggtcgtgcacccgtttttggattaagaggtggtgttgggcaaccgccgccacctgtggtaagtgagtaatacaaaggacctgtgagccctcggcaatcaagcgaatcttatcagcaatggcttgggcaacccgcccggaaaccccggtatcgacttcgtcaaagatgatgctagtaaccccttcgccctgggcaaagatcgtctttaaggccagcatcacccgggaaagttcccccccggaggcgatccgggccaagggtcccattgcctcaccagggttggtttgaatgtagaattcaacctgatcgatcccggtggcagagaagaccggcttcttggttttggcaaagttcacttcaaaaaccgccttatccatgtacagttcctttagttgggtgtgaacctgcttggctaatttgcgggccgccgtttgccgcacttgactcagggcgttcccttggtttaacaaatcggcctggaccgcatttaaccgctcttccaaatcggaacctgaatcggccgcggcctccatatcggtaagctcttctttgatctggtcgtagtacgccaaaacgtcggctaagctttcaccatacttgtgctccaagtcggcaatcgtcgctaagcgggcgttgatcgtggccagtcgctcctcatcaaactcgaggctatccaactggtggccagcttggttggcaacgtcttgcagtgaatagtaggcgtcggaaagggactgggccaggtcatcgtattcgggatcgaagggcgcaatctcttgggctgcattcatgatggtggcgacctggtctaagaccggcgcctcttcgtcatcgttcaacaccccaaccacctgctggagggtggtggcgatctgttggaagtgttccagtcgctcacgttcggcgattaattcatcttcttcgtcggcccgcaagtcggcgtcaccaatttctttaacttggtagcgcaacatgtcgaggcgctgggcccactgttgctcgttggccttcttttggttaaccgccgcctccaaacgccggtactcttggtactgctcttggtacgacgctagtaggggctgaaccttagcgttagcaaactggtcgagcattcctaagtgcgcctccgggcgtaagagcaactggtgctcattttgaccttggatatcaaccagcccgcttcctaattgcttaagggtggcggcgttgaccaaggtcccgttaacccggatcgtgttccgcccgctacggtggatttcacgggaaataatcaaggccccgtcgtcgtggctgattcctagctcatctaattgggcgacgtaacccggcagtttgggaatttcaaactgcccttgcaaggagagcttctcttctcccttgcggatgaactcctgggacccccgtcccccggccagtaggctaacggcatcaatgataattgactttccggccccggtttccccggtcaagaccgtcatgtggtcgtcaaactccagggataggtggtcaataatcgccaagttgtcgatcgttaactcttgtaacacgctctttcccccgcttcctaacgaagactattaatccgttcttcaaattccgcggcggccgtttgggattggcagaccaccaaaacgttggcgtcatcaccaatcgccataaagacctccgggaacttaagggaattgactaacagcgccattaacggtccgtgccccggctgcataaccaaccccaccattcggtcactgcgctttagctccaccaagttgctcttgatcgtcgccgtcagttgcgcttctttatcctcttggtgatagttagggaggctgtagtggtagccgccgtgggtcgacggcaccttaatcaacttcatttctttgatatcccgcgaaatcgtcgcttgggtaacctgaatgcccgcttcccccaaaaggcggaccaaatcatcctgacgctcaacatcgttttcttcaatgatttgctgaatttggcgttgccgatcgacctttttcattgcacgttcctccttagctatttaactccgcgtacgcggcgtcaataacgtggttaatatcaatctcgggagcaatttgagcgggacccgtagccaacttaaggtgcgccaagaattcgacgttcccttgcccccccttaatcggtgagtagtccagtcctaagacatcaaagccatccgcggccatgaaggacaaaacccgcgtcaaaacctcctcgtgaaccttacgctcgcgaatgatcccatgttttccgacgtgttccttaccggcttcaaactggggcttgatcagcgccaccacttcgccaccgggggtgaggatctgagccagcgggggtaggatcatcgacagtgaaatgaaggagacgtcaattgacgcaaactccggctgccccgccgtaaagtcctcttttttcgagtagcggaagttggtttgttccatcaccaccacccgggggtcatcccgcagctgccacactaactggttggtccccacgtcaagggcgtaggagcgcttagccccgttttgcaacatgacgtcggtaaagccccccgttgaactcccaatgtctaagaccaccttgttttcaacgctgatcttaaatacttggagggccttagcaagcttcagtcccccccgtgacacgtagggcatcttcttgcccttcatgtgtaaggtagtggtgacgggaatcttttgccccggtttatcgaggcgctcgttgttgagccccaaaatttcgccggccattaccgcccgcttggcttgttcacgcgaatcaaacaatccctgtttgactaagagaatgtccacccgttctttttccatattttacccctagatgcgatagtacgctaaaaaatcatccaaaattacagtctctttaccagtcaggcgccccagttcggccgcggcgccccgggcggtggttaaggccgcctctaattcccctttggcccccgctaagcctaacaagcccgggtaggtgtttttttgctcagcttggtccttatgggtcgccttgcccatttccgccgtggtcgccgtcacgtctaagatgtcatcgtagatctgaaaggccaacccgtaagcttcgccaaaggtggttaagcaatcaagcaccgctgtttcttgttccgcaatcaagcccccggctaaaacagcgtagcgcaagagggcgcccgtcttttgccggtgaagcttctttaactgggccaaggataactcctggccggtggctgacacatcggtggcttgtcccgctaccatcccggctggccccgccgccttagctaattcttgaaccagccgcaagcgaactggcgcttttaactggttatcactaacccactcaaaggcgagggttaataacccgtccccagccaaggtggctacccccgggccataaacccggtggttagttggcttcccgcgacgaaggtcatcgttatccatggctggtaaatcgtcgtggattaacgagtaggtgtggatcagctccaaagcacaagccgcccgcaccaagtcgtcatcaatggtctttcccagcagttcggcaaccgcaatcgttagggtgggccgtagtcgcttgccccctgctaacagggaataggccatactcttttccaggagcggctgatcgcaagcgccggctaggtgggtcgccaagtagtcatcaaccacggccactagttcttgtaactgccgtgccattagaaaacgtccccatccaagaattgcgacttgtagccctggttttgcaccccgttatttgaaacgtcatcgcccttttcttcggccgggtgcagctgcccattttcgtccatcatctgggctagggtcgtttcggcttcattaagttgccccttcaggtcgttagaaagggtcatcccctccttaaatagttcaatcgagtcgttaagcgacacgttgccttgttggagcttggtgacgatttcttgtagtttcgctagttgttcttcaaagctctttggttgacttgccattagttgttccccttttcaattttggtaaccgttacttgggcttggccctgttcaaacttaaccgtcgcctcgtcaccaaccgccagttggtcaacgcccgccaccacttgttcatccttggtgaccaaagcaaaaccacgccctaacaccttgagcggactcagggcatccagctgctttattaacgtgtctaagcgttgcgcttgcccccgttggtagttttgggtggcctgaagtagcaagttagttgaagcccggcgcccctcttctaagcgaatcaagcggccccgctcttcttccaagtgcccgcgcattccggcacgcaggccctgttgcaaccgggctaattgcatctgttgcttagctagctgggcccgcggcgagtgatgctccaagctggtttgcagctcttgaacccgccgactcctggacgctagcagtaaccgggccccgctctgcagtcggccagttagttcatcgacttgttggacctggcgttcgtacaagcgctcaggttgcttcaaaaagtagctttcggtcagggccaagaggcgttgttttaggttcgccagttggctcttttcggcggtatacagcagggtttgttccctttccacttcggcaatgacgtcggccaggggccacttggtcaccgcctcggccgcagccgttggggtcgccgtccgtacgtcggccaccaaatcggtaatggtcgtgtcggtctcgtggccaatcgaagaaattaccggtaggttggcctggttgatcgcccgggccaccacctcttcgttaaacggccacaggtcctctaaagaaccacccccgcgggccacaatcacggcatcgtaatcgttagcgtcgctgacccgcttaatctgggcggcgatctcaccggccgcttgttccccttgcacccgggtcgggtaaaaaacaagttgaactaggcggttacggcgccggacggtggtaatgatgtcgtgcttgacggccgcatcgttagacgttaccaccgcgatccgcttggggaaggggcgcaccgtttttttcggtcggtcaaagagcccctcttggcgcagtttcttgtacaactgctcaaactgcacctgcagggtcccgaccccggtcacttccatcgcctcggcgtagagttggtaattaccacgggcttcgtagacggacaggcgtccccgaatgatcacccgcatcccgttttccggcgtgaacttaaccttggcaaaggcactttgaaacatcaccacggaaagctggaacttcccatcggcttgatcgtcttttaaggagaagtactggtgggttttacgcaggcgaaagtcggtcaactgcccaaccacgtaaacgttacggttcaggtagggatcggcatcaaacttgcgcttcacgtacttggtaagttgggccaccgttaaacagttcttctccgcgatcatttattcttcactccactctgctaagtctacggtttgggccatcaagctagcgatcgtcattggtcccacccctcccggtaccggggtaatcaggctagccttttccttcacgttttcaaagtcaacgtctccgcacaggctaccatcttctaagcggttaatccccacgtcaatcaccacggcgccctctttgacgtcttgggccttaacgaactgggggtgaccaatcgccacgattaagatgtcggcgtgccgcatgtaaaattcttcgtccttggtgtgggccgacagcatcgttaccgttgcgttccggttctgcaagagtgattgcatcggcttgccgaccaggatcgaacgtcccattaccaccacgtccttgccatccaggtcaacgttatagtgatcaagcatctttaacaccccacgtggcgtacaagagaccgggtatcgcttgtcgggatcgtcattatagagccggccaacgttataagggtggaaaccatccacgtccttttccggaataatcgcgttgtcgagcgctttttcatcgaagtgcttcggtaagggcgattggaccaagatggcgtgaatgctcgggtcgttgtttaactcctgtacacaggccataacttcttcttggctggcatcggccgggaaggtctttaacaccgacttcatcccgagcttttcggccttgcggtgcttgttgcgggtgtagatggcgctagccgggtcatcaccgactaagatcacggcgattcccggggtgatcccccgcttttttaacgccgctacccgagtcgcagtttcttcgtttagctgcttggctaattgcttaccgtcaattaattctaccatggtaaatggttcctccctcactgtggttactttctggttaatgttcggattatggtgtgcgattaacaactaactcccaccaaagttccgtttttaccatggactgattttaacacgcccgaccagtgcttgaaaataagaaaagggcgccttgctaatcgcttggctcccctctccctagttactagtggttttcggccccccaatgtggcccaacaccccgttgataaacttacgcgatttatcatcgctaaatttcttcgtcatttccagggcttcatcaatggccacggccactgggacgtcatcaacgtacttcatttcgtaaagggccaagcgtaggatgattaagttcggcttttccacccgcgaaaggctccaacccgccgctagtgagccttcaatctcttggtcaaactcggcttggtgttcactaaccccagttaccagctcttccaagtaggccggcacctcttcttgaggagcgaggggaaggagctccttgtataattgctcccagtcaacctctgggtccgaggccatggcaaacaaggtctggaaggccacttcccggattttgcgtcgtttaaaagtcactaatcttcaccatcttcactttcttcttgtccgaataaattatcagggtcgacaacctgttcttcttttggcgttaccaccccttgaacgtgaacgttgacttcgctcaccgtcaagtcggtcatcagggccacttgttgggtaaccttatcctggatttcagccgccactttcggtagttgggcaccataatcgaggtaaacgtcgacgtcaatggccagggtttggtcgtccttgttgaacaacttaaccccccggcgccggtcggagcgacccagcagttccccaacgttgtttgctaaggaaccgtgcatcttagaaaccccatcaatctcattggccgcaatcccggcaatgatttcgataacccggggggcaatttggatcttgcccaaggactggtcgtcactatttaaaataatcgttgaatcttcagccatcggtttggcctcctatctacattaaatcgggcacgccacgcatgcgttatcttttacattttgcactattcatgggcaaattgcaaattctcacccaatcacaaacaggccggtggggaccttagttaacacttccgcgcccatgtgggtcaccaaaacatcattttcaatccgaatcccgccaactcccggcaggtaaacccccggttcgacagtcaccacctcattgttacggaacttatagcggttagtggccgggccaaaggaatccggaaactcgtggaccgccattccaatcccgtgacccatcccgtggttgaagtagtcgccatacccggagtcttctaagggtttgcgccctaacatatccgcttcgttacccgtcatccccaccttgagttggctaatgacgttcttttgggcggcgtcgatcaggtggtggagctcaaccaggcgttggtcaagctgacccacggcgaaggtccgggtcatatcggccgtgtagccatctacgaagtagccaaagtctagggtcaccaagtccccttcctttaagtggcgggccgaaacggtagcgtgcggcttagccgaattcgggccactggctaagatggttggaaacgaagcccggctggccccgttttttttcatccagtagtctagctccagggctagctctcgttcactcattcccgggtgggcaatcgacaagaggtagttgtaaccccggtcgtggagttgcgtagccttacgcagtttttcaacctcgccagcgtccttgacccggcgcatcttttccaccacccggtcaaagggcacgatggcggcttccatcaggtcgtccaaccgttcaaaggtccggtaactaagggtgtcttcaaagccgagcaccgacaccttcattcccttacaaatcttatttagatccccccagtaatcctgggtgatcgttgcgaccacttcatctgatttaaactcccgtaaggcttcttggtagcggctatccgtgataatcacggcgtcggtgttggtaactaacagccccccgtccccctgttctaggtcaaagccagttaggtagcggaggttcgttttatcggtcaccaaaaacgcatcaatgtattgcttttcgaagccggcccggagtcgttcaattcttgtcttcatattggtcccttcctgagcgctataactaattttgtttaaaaacataaaaaaaccgcaagcaaattgcttacggtctattatgagcttattcagccactgggtaaacggaaaccttacgcttgtcccggccaaggcgttcgaacttaacaacgccgtcaaccagtgcaaacaaggtgtcgtcgttaccgcgaccaacgttttcacctgggttgatgtgggtaccgcgttgacggtaaagaattgaaccggcagtaactacggaaccatcagcagccttagtaccaagacgccgaccggcggagttacgaccgttggcagtggaaccgccccccttgtggtgggagaagaattgaagatccataatcatagttgttcacctccagcaaaagattaataaaacattttaacctcaaggaattctccgtagcgctcttgaagatccataaggccactcgcaaagactcggagaattaattgagcatcgtgaccctgatcaatgtaggtaacctcgaggtaccccccattggccacatcctgggtaacggtggcttcttttttcagcacccgttccaaaccatttacagtggtaattgtcagagccgagaccgcggcacacacaatatcttgcccatcaggaccagattcagcgtgcccggtcatcttaaacgatgtaattttctgatccggcgtcaccgtaaatgagactcgaatcattttaacacctcattaagcgttgatcgcgtcgatcgttaccttcgtgtacggttgacggtgaccttgcttagtgtgggtgtgcttctttggcttgtacttgaaggttacgaccttcttttccttgccttgcttgtcaacagtcccttcaacagaagcgccgtcaacaaatggcgtgccgatcttagtgtcgtcaccgcctacgaagacaaccttgtcaaaggtaaccttgtcacctgcttgagcattgagcttttcaacgtagattgcttgacctgcttctaccttgtattgcttgccaccagttacgataattgcgtacattctgtgcacctccttaaattaagactcgccaagacgagtagcgaatgcttttaaactcgccatcgtgcggttgtagttgtggggtcacaaatacaacgttttgattttaccaaagaaccgccccttcgtcaactcaataacgaaaaggcggtcccaattttatttaaatttctaagccgttatgggtttgaaaatccaagaaggagataatcaacaggtgactgctagcaaagttgttgagcatcttctccaagctgctggtcatgtaacgtggtgtgtagattaaccccccatccaaccagcggatgatcaaccccaacagcgccgaggtaataaaggcgacctggatccgcaggggaacgtcaatttcctctaggtcggtcccgagccccttggcgtaattggtaattacttcggttagccggttatacaactgttgatagaagtaacggttttgttggccactcaacaagaccgtaaagacatcggcatttttctcgatataagaaaaggtctcgctaacgctcatggtctgcaaaatcttaccgtcagtgacttcacggggggtccccttctccaagacgtgttcaaagagctggtcgataatcccattcatcgccgcttcgacaaagtcctgcttatcccggtagtggagataaaaggtcccccgtgtgatattggcggtcttcgtgattttttggacggaaatgttttccagcttttcgtgttgcatcaggtaaactaatgcccggcgtaagtttgtttgggtcttaacaacccgtggatcttgtttaatgactgtcatcttaccgaacccccattcaagaaccttgacactagctggtgtctttgatataaaacgtaccttctctatcccttactccctattatatgttcattacaaaccgtcgtcaaacgcttacttgaaatacttgactattattatggtggtttctgatcgtgattgacaagttccggtccgctctttatactaagatggtccgggacggtagctcaaccggatagagcattggtcttctaaaccaaaggttgtgggttcgattcccacccgtctcatttttgaagaattttgaagaagcctatagaacaacgaatccttatttgaagcggttttcacgacacgggaaaaactgaaaagccccataaaattttgaagttggtgcacatttggtgcacacggcacttcgggatgatgttttgtttaaaattggtctagttgctaagggatgtgcaagaaagcaaaaagaaaagaagcccgccacatcaacgttttaagccgattagtcccagtaaagctaaaataaaaaggtcctgcttaactgcagggccttttttacaaattatctttgaaccatcgttccttcttgctggactttttaaactcgtttaggacccaaactttgttgctgatgcagttgtccatcaaccgctcaaggccaaaaacctcgtttgataggaattttggccacactggctggggagtttagtcgtggcataggacaaaaaagtctctatttaaattgtctattttattgacaggggaccattcgagtcggatcgcatgatcgtttatttcctggtcaaaatcgttctaattcagccgttaaattagtcagattagtgacgataaattcatgtgaaaagattagttcaccagctgctcgagttgatttaatataaatctgccgtggcttaggccacgatgctgattgataaatttcagagtagtaatgagtctcttcctcttgccactgggtttgatcactgatcttgacgaacttttcagctagattctgtaattttcgattgcgtttgagtcgaataatgtaaaacacatctttggcttcacagacatcgtaaacttctggcgtggcgaagccactatcgccacgaaccagaatgtcagtcgtaggtagctgagtttgataatgttttaatagtggtgttaaaaaagcttttacatctttgctggtgtaggcatttccaggacgcaagacagctttcaataagttaccatcttgatcagttgccaataatggatggtatccttcagtaccataatgtgcgttgtagttagtggcttcctgtttgccataagtgtctgagtgagtcgaatcgatatcaataatcgtggctgtctggttggttaacagtcgagcccgatcgataaaagcctcatttaaagtctgtaatgtgctaacactatctttatcaaaacgttgccaaaaacgtgatattgttgcttgtgaagccaaagacggtttatccaataataatttaaaaagtggttctttttctaaaaaagttgccgcagaatctgtgctataaccggcaataatctgaagaattaactgttttaagatactagaattactgtgttgacaatatcgtcgctggtcattgaacctcaatagtttatcggccaagttggtgaactgaaactttgccatcagttctacacacaatgttagcccgccatcggaagataattgaccacccgtattcgatattaaaatatttttgttgaaattgaatgccatttcctgtaaagttttcaatgtagagtcctcttctctcatatggttttgtttgacaatttaactataccagagctgaggctctttttgtgcacttaaaaggtgaaaatgcaaaatacccatcaaacacatgtttcacgcgtttgatgggtattttgcatatctctgtgaataaatcaggcatcttaaattattttaattttatttccactactaaattcagctgcattagttaaattttacaagacttcatgaatagtcacaacgcctacaacatcttttttatcatcaatgacaattaaatttgaaatattatgactagccattaactgccaggccgtttggttacgctgattttgatcaatactgacaaagccctccgtcatataatcagcagcaactgatttcttcactgaagcgacctgcaagaactttttccgaatgtccccatcagttacgataccaataattttaccagtctcattttcacgaactaaggtcaacccaataccataatcactaattgtataaatcacatcattaattggtgtgtcctgattaacgtagggaaccttagtatgcataacatgtttgaccctttggagtaacattttgccaatactaccacccggatgatacttagcaaactctcgtcgcgaaaaacttttttgcttttctaacgcgaccatcaatgcatcaccaaatgccaaaacagctgttgttgaggccgttggtgccattttagttagatcgacttcttcactaactcccaaatcaaacaccagtgaacaattctgcgctaaagttgattcagtatttccagttaatgctactgtttgcaattgatcatgaaagatctgctgcaaggcaaacaaagcctgcagaacctcttgggtttcaccgctatttgaaacaaataataccaaatcatcagctgcgatccgtcctaagtcaccatgataagctgttccagcatcaacagcaaaactggcattgccaattgatgaaagtgaggcggcaattttttcagcaaccaattgcgattttccagttccaataaaaattattcgtcaagaaatctcagcagcttgttcaaccaattgatcaaagctagcatcaagccgctctgagacatttgttaaagcggcggcttcctctgcaaaaacctgctgagcaattttataataagccatcttgatcccagctttctttttggtcttgatattgactaaagagtgctgcagcagtcgttaaaatcggtcgcattttattcagatataattgattgtcagcgtccgaaattgcagttggcggattaggatggacttcggcaaaaattccagcaacgccaatcgttaatgctgctcgcattaatggaaatgcaaaatcacgattaccgccagaatggtttccatgtccaccaggaacttgaactgaatgagttgcatcatagattactggatagcctaattgtcgcagttgtaacaaattagtcatgtcgacaatttgctggtgataaccaaacatcgttccgcgttctgtcaataaaattttattgctataaggaattactttatcaatcgcaccctgaagatctcctgctgccataaactgggcctttttaatatttaccacccgcccagttttagctgccgcaactagcaaatcagtttgccgacttagataagccggaatctgtaacacatcagcaacttcagctactggttgacactgataagattcatgaacatccgtcacaatcgggacttggtattcttttttgattcgatctaaaatagctaaccccttttccaagcctgctcctcgatcagaagaaccggaactgcgattagctttgtcaaatgatgatttaaaaataaaattaatcttaagttcatcggttaaatttttaagttgttcagcaacttgagcacacacttcataagattcaattgcacatggtccagctaataaagttaagtgctggtcattaaaatgatagtcggaaaaaacttcagcaataccacccatattaggatcctccttctaaatcaaatactgcaacaaaactgctgtcttaaatttagcatgaaaactcttaatagtcgtcaatttagtcctattcaagaaaataacttaggaaaatcaaaggtcaattccaaaatgttggtgtaaattaaattccgcgaatttatcatttcacaagcttaagcataccggcttcttctgaattgtcatctttttcaatcccgtggtaaacggtcatgtttaagtaccgtggaccagcagcccatttttcattctgttcaatcagtagtgctcccattagtcgcaagacgcttagatcattcgggaatatccggattacacggtcacgacgacggatttcttgattaacccgctcaattgtattattcgtccggagacgcttccttagctcctctgggagctggtaaatcaccattaattcgtcaaaactattttctaatttcttcaccaccttagggaactcggtctgccaatctttaaccaattggtcacgccgttcaaccgcttggtcgtacgttagagcattaaataaatcttggagtcggttagcaacttctttacgatccttgagtgccagaatacttgtacaagtcattacaaaaatgaaattgacatctctgccaaaggctaccctgaaattgcgtagtgattgcatcctttaagccacaatgagcgtctgaaacaaacatatcaacgttggtaaggccccgctgtttaagttcactaaaaaagtccatccatgaagcttttgattcactatcaccgatatcaaaaccgagcacttatcgacgaccgctagggtcgattccaatcgcaacgagtaagctattacttgtcacaacgtgaccacggtgtaccttaaataaaattgcatcggcatacacaaaagcatacttttgcgtaaggggacgtcggttaaaatccagcacttggtcgtccaaattactgcataaagccgagaccgtacttttagaaaaggttgtcccacataacttcttagtaatctcagctactttacgtgttgaaacaccttggattaccatttccattaatgccaaatcaaaggcctgctcactacgctggtagcgtttgaacagctgtgttgaaaaattgccatgacggagtttaggaacgtgtagttcaagtgttcctactcgtgtggtaagctgacgaacccgataaccattccttgaattggttcgctcatccgaacgttcataagccttagctttaatctgctcagtcgcttcggacttaagaatttcatcaaggatcttggccataattgattgcatggccttatcccgatcacctagtaatagctcctttaattcgtcatcctctaaatttaattcaacttttggcataatgaagttcctttcagatttcacaaagtcctatttagaatttacaccaattatacggacataaccgtgaaatcgctgatatggttgagagaatgtacggccactactactcaccaaccacggtttcaaacatcactaagcggacggaacacctggttgaagagttccacgagcgcaaattcaagtactcacagtacgtctgtgtgttcctcgatgctacttacattccgttacgccgtggtaccgttgaacgagaagccgttaacgtagcgatcggaattcgaagtgacggcggtaaggaagttcttgactacagtatcgcaccgaccgagaacggagccgcttggtctgaactactccagggattacgcgcacgggggattagagatattcagttgttcatcgccgacggtttagttggacttcaatctgcgattgaggctaactacccgcaggcgaagtttcaacggtgctgggtccacgcagagcgcaaccttttagggtacgttcgcaaaaacgatcgcagggagattatcaccgactttaaggctattcggcaagcagagaacctacaagccgccaaagaacgattggcggctttcagtgctaagtgggagtccagttataagcgtcgaatcaagaatctagtccaaatggaggagctattcacgttcttcagttttccaactgcgatccgtcagaccatctactcgacgaacctaattgagtcgttcaataagagcctgaagaagatggtccgacgtaaagagcagttcccaaacgaaggagccctcgatcgctttatcatgacgcaagtgatggagtacaacgataaatttgagaatcgagcacatcggggattcaaggactgtcacgacacgcttgattcgatgttttagaattgccaattcatgcggacgaagtttccttttttacacaacattcttgacactctcccttctgtcaccagctgttctaagtcttcaaacgtttgtggttgtggtgagtgtgctaaccagatagatttaaaatcagcccaccagtgctccatcaccgcattatcagctggtgttcctggggctgagtaactatgttggctgttattactagccaagtagtggttgaatgctttggaagtatatgctgctccgcgatcagtgtggattagcggtgccagacctccaactttctgcttggccatttgaaatactttaatagccccagtactcgtttctgtaggcgtaataatccagctaagtgggtattgaccgtatagatccaggacaacgtgtagacggactttgtacttacgaatgttgtaggcaatttccgtcgtgtccgtcacccacacctgatttgcggcagcttgttcaaactggcggttcagggtattctgtgcttcataagtttcctgctcctgcacacgttttctcttaggctgacgatagtccgctttaatactgtgttccttcataatgcgcatgacgcgcttcttgttaactgtgtatgataatctttcctgctttatcaaacgggtcatcttgtcataaccaacgcagtgtttatgttgtgcttctaactgtttaacgagctttagaatttcttgatcttgaatatcatgaaccgtcggttcatgggtaagccacttgtagtaagcctgccgacttaccccggctgctttaactagatcggataccttataaccactttggctcatttcctgaatcgcttgatatcgtccggccgttccacctcccgattgtgtatttcgaccaatttttttgcgaaggcaatctgtacctcccgttccttctctttagctttcagctgccttacttcttgtcgtaatctttccacttcattggttggtgttttgcttttatggcgaccccggttatcctgaagggattcccaatcgtgagttctttggtactttcgtacccatgaatagacccgttgatagctgacattaaatttttttgccgcggcttgatagttatactcgtgatcaattgtccattgagtaatttgccgtttctcctcaaaagtaacttttcggcccactttcctagctcgctttcttgttgcgtaagcaacacttaattgtccactattgtaccggacaatccattgatgtagttgggaaagactacgaatttgatatctattgagaattgcttggcctgacagggtacctgaaaggtaagctttaacggctgatcgcttggtttgaagtgtgtacctgtgattgtgttcagggcgaatcaatccagccaaaccagccgttaaaaattgtttaatccatctgttaaggctagaggtccgcacctggtgataatccgcgtataccccgagtgagtagtctgaatcttggtaattactgagtaaccttaatttttccgtcgttgaatacgttcctattcaaaacaccccctagagatgacacttttattatttaaagtgtcaaccctaaggggtattgtacgccgtggtaaggagctgaattttttctatctctcacctgcacactcccgcagcgctggttcaccgcaagatcaaggataacgactaattcatctgcgatcggttatattataacttttttcatcgaataacttacaaatagccggcgattaaattctttatttcaaataaattaatccaatgtaacaaaaagtttacaaagctattgcattttttgcaaaatgggcaataataaggataggcaatgtttatgggggtgaaaagatgctaccgttctttatcattgtgttaattctttctttatctgtagcaggtcaaatttactttggcaatccatctcgaagccaccccgttggaaaacatttccaacgaaaagcatagtctttgctctcactcaaaaagggaaaccgttcgctcgcggtttccctttttagttagtttgttttggcaatggttctttcagcccgttggattagttgttgatgggcggccatgatttggtcagccgaaacgccgaggtccaccagccccagcttcaagagcaagtgccaggcgtgacggaagtcttcttggcggtggctgaagtaactgcccaaggtaaagtttttgatggccaagtactccttgttgagatccgctaccttggtggccggcttgaccgctaacaaacgggtgaaggcctggtcatctaaaactaccaaatgcgtccattgcttacgcgccgccatcagcagggccgcgtggagaaccttggtgtactggccggctaggtcggtagctgctggcttttcaccctcatcgtacacccggctccaaccaactaggtttgctagcttggccagctcaatgtcgagggtggtgacaacgttagctaagcgtgcctcaggacccagcatgacgtcctttgcttcaaagaggcggttgtcagttgcgatgacgtcctgcagtaaaacggtgatgttaagcatcttctaaggacgcctcctcttttacctgggcccggggtgcaaaatgggtggtttgaatggccaacgctgcgcggttctttaagtaccagttccgcacaatcgggtagtgtaacaaaataccgaagaacgaggaacgctcattttcgtccagaaccctaaagccccactgctggctgtaatcctcgggatcaaagcccagttgcagtttgataccgcggtctaagttcagctgggcaccgttattttggggcagactcatcaagaagtaatccgtctcggttgtatcgatgaagagcttgtcgattacggccatatcgaggtctggtttttgtaagccaaagacggtctggttgctcgtcgaaagcatcccgaggtcaatccgaaagtctaagcggtcttttaacagctttgcaaaggaaattagcggtgccaaggcctcttctaagtccaagtcgttatagttgttgacctgcttaacaataaagaagtcgaccaaggcctggtttgaaaagttcaataaccggttctccaggtcaatgtaaaagagtggttcgtggtgacgctggtcggcgaaaaaggcccccgcatgctcattggctggctcaaacttaaaggttaaaccctcttctagtggttgaatgttcgcttgtaaggcgtggttgtgttggctaatcgccaccccgttgatggcgtttagctccagcatgcgactcataaacaagaggtagtaatcagccggttggtagtgctgggggaatttcacgaaggcgttggtcaagtttaagttgactaactcctcggttgccgacaacagatcctggggttcattggtttccaccaattcgtttaagaggtccacgtagcgtttccccactaacaaaccatcctttaaagaagctgacaaggcccgcaccttatcggtggccgtggaaacaatttgactgttactcattgttactcccccgctttccctcgtcactggccccgccactcaggctagctaaatagttggcgtacaggctccggttggctaactcaaagtcttcaaaggagccaaagacgtcgttaatcgacttttgctcgtaggaaaggatcgtgttttccttggacaagttgagtatcgtgcgttcgttttgcttaatgttttccgccgccgtccgcgcctcttgatcgaggtcttcgaggtgagcaatctcttcgacaatcaactcccggctctcccggttgcggctggattcaaagatcccgctacgggcggtgatgtcttttagttcctcttgcaattcggcccgccgctgttcgcgagtcgtcgcgtcgtcaattaaggattgtagccgttcgttttccttggacaattccccgatccgcttgctgttgtaacgcttgccggcttgggacagcttgaaagcctgggcgagcttatcgtattcttctcggttaaagatgaagcgaatgtttaacacgtccagctccccgaactggcggcggtcccaccagttcccaaagtaaacccggtagtggccggtctggtattcttcatagtaaaagaaggggtaggccttgccaaggtatttaatcaggttgctgcttaagtagttgctgagttggtcagccaagttatccactaggttcatcacccgcgagtcgtttggttgctgctcacggtgttcgatttcggcagcgtagcgctggttatcgagcagctggtagacctggcagtcatcatgatccgcaatggcgttttgtaactgttgcagataatcaattttggtcgcaatctggccgttaatcacttctccaatgctaacggcgccgtgctgttgttcttcattcgccatatgagtttctccttatcatggttatagctttatcttagctaatttccgcccttttttaaagtcagttcaccattaattctaatccgcttcgccaaacggtctgaaacaaggcgcactggcccaactaaaaggggttctcgctggtccgatatcaaaataattatcaaagtagcttgcaagttattcaattcgctctataataatcgtattcagtactttacaaatgtagagtattgaatggctaattcgaaaagaggcgaataatcaatggcacttagcaagcaagaacgtaaggaaatggccagaaaggcgatggaaaagcgtgggagcaagaagccagatggctctggttttgcccggattgacgctgacgcgaagaagttagaaaacgaataattgcttaaaaaagctcccgccacaaccggcgggagcttttttactattatacgggggcaataaccgcatacctagtgcctaagcaagccgaagaacggtgcgtgacgcaccaaccgttcgttcgatcttacatacggcctgccgagtaggttatttcccactctcagtcgtgtttagtattcgctcatgtacttgtcttgttcccacttggaaacggattggcggtagccttcgtattccaagctcttagcctcattaaaggagcggtagaggtggtcacctaaggccgccttaatcacgtcgtcttgggccaggctcttcaaggcgttgtgcagggtgtctggtaagtcgtggatccccttggcttgccgttctgcttcggtcatggcgtagatgttttcgtcaacgctatcagccggctttaaaccacgcttcaaaccgtccagcccagcggctaagatggcagcaatggccaggtacgggttagcggacgggtcaacggaccgcaattccagccgggtccccatcccacgctcgcttggaatccggaccattggggaacggttagaggcagaccaagcaacgtaaactggtgcttcatagcccggaaccaggcgcttgtaagagttgacgatcgggttgcagaccgccgtcacactacgggcgtggtccatcaccccagccaagaattggtatgcggtttgcgaaagttgaaccttgtcttgttcgtcgtagaaggagttgactaccttgccgccttcttctttaaacaaggacatgttcatgtgcatcccgttcccgttgatgccggccagtggctttggcatgaaggtggcgtggaagccgtacttcttggcgatcgtcttcaccactaacttgaagatttggatgttgtcggccgcttctaaggcgtcggagtacttgaagtcaacttcgtgttggcccggtgcaacttcgtggtgggcagcttcaacgttgtaacccatggattccagggccaaaacgatgtcgcgacggcagtcttcacccttatcagctggttccaggtcaaagtagttttcttggtcgttaaccttggtggtcgtgttgccgttttcgtcggtttcaaaaaggaagaattctggttctggaccgatgttgaaagcagagaatccggcgtcgttcatttccttgatgacgcgctttaagttgttacgtgggtccccagcaaatggcgtcccgtccgtcaggtgaacggagcagatcacttgggcaaccttaccgtgttctgccccccatgggaagaccagccaggtcgacatgtccgggtacaggtacatgtcactttcttcgatgcgaacaaacccatcgatcgaggagccgtcaaacatcaccttgtttgctaataatttgtcaagttggctaatcggtaagtcaacactcttcatcgtgccaaagaggtctgaaaaggtcacccgcaaaaagcgaacattttcctccttaaccagggcgtgtacttcgtcattcgtgtaaacatgttttgccattgtctgctattccttcctctgtatcatcaagtaacatcgccgatcattaggcgattggtctaggtcatatccttaaccgccgccgccgttattgatcggcttttttaaatcgatggatcaataataacaaccccgcccgttaaaatcaatcgattctcgctggtttgaaaagagaatggattgctaagcgctttcactttatttttttaaccaaccgttaatcaaggcttcaatttcttcagtcgtgttttgctggctgaccagatcaaaccagtggaccgtcatttggttgcgaaaccaggtcaattgacgcttggcgtagtggcgcgaatcaagcttgatcttttctagcgcttcttggcggctaaccgtccccgcaaagtaggggaacagctcccggtaaccaattcccttgccggcctgttcgttttcgcccccctggtcatataaccactttgcctcttcaaggagcccgttggcgaccatttgatccacccgctggttaattcgctggtataagacggggcgttgcgtggtcaacccaatgatcaagaagtcgtttttagccggtggttggggttgggtggaaaagagtgcacccgtcttttcaatcacttccagggcccgaatcacccgccgtaagttcgccaccggaatcttagcggctgccgcggggtcgcgctcgtttagctgctcccaaacaaattgcttgccccgctcggtcgcaatttggtgccagtgatcccgaatcgccgccgattcctgatcgaactggtcgcggcccagggccaagttttcaaccagggcctgaaggtaaaagccggtcccaccaaccaccaatggcaaatgcccccggtctgcaatttggtcaatctcacgctcagcggcgaccttaaaatcagccaccgaaaagcggtcgtgaatgtcttttacgtcgatcaagtggtgcggaaccaagctccgttcttccgtcgtcgccttggcggtcccaatgtctaggccccggtaaacttgcatcgagtcaccagaaatcacctccccaccaaacttttgggccacccgaagtgacagggcggtcttgcccaccgccgtcgggcccacaattgccactacctttgccatcactgatccctctttctttgattaatctagatttaactggtaaagccccttcaaatcttgcataatgatgttaattagaattgaagggggtattttttatgaagcactttacgcgtggtttcttctttggtagcttaacgaccctcggtgcgatcgtcagtggggcacttgccttccacaaggccgtgatcaagccgattgaagaagaagaaaccaagttcgatgaaaaccgccgttctgctacccgcaagaaccgttcggcacaccaattgtaaaattaaaagggggacgtcgcaatgcaacgtcccccttttaattttcgacggttacacagataacgtggaaaccaaccgcaggcctagtgcctaagtacgggcggagaacagtacgtaccgtactaaccccgccctagctaagtcatacgacctgcataggaggttgtttcccacttctcttaatcaatgtacttggcctttttagtcttcccttcccagcgaacgtagccatcctttaagatgtacagttgcttgaagccgtgcttgttcaagtacaccgccgcttgggttgacaccgtcatcccttcatcgtagaggtaaattggcatatcggcacgaaggtcgaccccttgctggcgaagcagggcgtagggaacactgcgggcgcctagaatgtggccccggtcgaactgatcctttggccgtaaatcaatcacctgggcacggcgaagtcccgcttggaattcctcttggctgaggaccgttgcgtaatggcgccggcgccatgcaccaagaccccagaccccgacccagacaatcaacaagaccaagataacaatgtttaacatcatcagaccagaactaactgctaaaaccacgattcaatcccccactaacattttttatgcaaaccggcgtgccaaggaagccgccccgatcaccccagcgtcgttacctaattcggctaacttaagttgggtcgtcgtccgaacggttgggaaggcaaattcttggaagttcttttccacccgcttgagcaagaagttaccggcagcggaaaccccaccaccgattaccaggaattctgggttcaaggcgtcggctaagttagcgcatgccagacccaggtagaaggccacttggttaacaacttcgttagctaagaagtcgttttccttggccaggtcaaagacgatcttagaggtaatttcatccccgttatcgatcattgccttcaagcgagcattaccttcgtattcttccgccttgtcttgggcaatgtgaaccaccccggttgccgaagcgtattgttctaagcaaccgtggttcccacaggtacaaaggtaaccgttcggttgaacaatcatgtggccaacttcaccaccggcacccagcccgtggatcaattcaccattggcgatcaagccaccaccgaccccggtccccagggtgatgaaggccacgtcgtcaccatcgttaccggcacccttccagcgttcaccgagggccgctacgttggcgtcgttgtccagggcaaacttcaggccggtaccttcttcgatttggtccttgacgttttgcgtcgtcttccagttcaggttgtaagcacccttaacggtccccttttccaggtcgatcgttccgggcgtccccatcccgatcccgatgaattgatccttactcatcttgtaaaggtcgatgtggtggttgatggagtcaataatgtccggcacaatgtgggaaccttcatccaaaatgttagtccgaagtgaccacttttcttggatttccccttcagccgtcaggatagcgaacttaatcgtcgtcccacctaagtcaacaccaatcagcttcttgttcgtcataatgaataatccctcttctaatttaagtatttaccttccggatgctcttcttcgagacggtgttcctttcgtaaaaccagcttggctttcatgtacacatcccgctctaaaacgccggcttggtataagttgtcgagttcaattgccatcagttcaatgtcccacaagcgtttaccaacgtacacgaagacgttgaactgctttaagagttgctgaacatcgtacagggtgcggagctgttcaatccgtttcatccctggaaaaacaccaccttacccagtagtacaaaccctaacattaatatcgtgccaccaagaaaccgttttcgcaagtggatttcccctaaagtaggaacccccacgagcgcgcacgctaaaaagccgccgaccagtccccccaagtgaccaaaaatatcaatcccgggtgcaatcaagtcgtaaaccaggttgataatcaccaagatcaggtactggcgcgctaaaccccgtagcgctgggtactggcgaaattcgcttcccataaagaggaaggccccgaaaaggccaaagatccccgttgaagcccccgccgaaatggttaccggctgaacggcgacgctaaccaagttacccatcaagatgctcaccaagtaaatcacggccatccgcaaatgaccagtcaattcctcaatggtccgtcctaagtagtagaggaccatcatgtttaaaaagaggtgggtgagcccgatgtgcaaaaaggcagcggtgaacacgcgccaccattgtccagccctaacaaagggaccataattcgcccccaggttaaggagggtggccgaattagtggccccgccggctagttcttcgagtaggtagacaagtacacacacacccaccaaacagcaggttagcggcgcttgttgaatggcctttttcacttttaatcaccacttggggtcagcactttgttcaccgtgatgtcaaacgggtcagcttcccattcatcttccgcggctacttgagtgtttaaggcaagggagatggttgctccctggtagttggctaagtagcggtcgtaatagccgcccccaaagcccaggcgcttcccagtcgtggtgaaggccacgccaggaaccaccatcaaatcaatctcttcggcgggaatgacggtcccgtccaccggttctaacaccccgaagctcgtttcttcaaaggtggtatcttcgtcgatggccacgaactccatttgccgatggggaagtgttcgtggcaccacaaccgtttgacctttataccgggcgtgcaggatcagcggggcggtgtcaacttcaaaggattgactaagcgttatcgccaccgttttagcgctaacccattccggttggtcgtataacctacttaccagccgcctttcttctcgaacgcgcgtgttcagatccagttgctggagccgggcaatgtaagccttgcgcatctctttttttgtatacgtcatctcaaatctctctcctttgtcaaacgtttacaaagatctattatcacagtttcccccaggggacgcaagcgtttttcccgattttgattgatcgcggtaataaaaaataggtgtaaaaaaacgctggtccccgctagctagtttggttctttcaggttagacagaaaacgtggggaataaaaaaacgcgaccgataaatatcgatcgcgcatgaagcgaagaactacttcgtttcgcggtgtaagaccaccttgtgttcccgtgggcagtacttgtttaattcaagacggtcgggattgttacgacggttcttgctggttaagtaagtccgttcgtggcatgaggtgcattctaaagtaatgtttacacgcatcgtgttgtgcctccaaactttgtaattttattaaacggtgttgtgcttcactggcacaaccctaactcgtacaactatatcatcaatcggccggtttggctagcccttttgttaaggatttttccttgacagagcttcacccctattcgctgctggacgagttttggacgtccttccagtaggcggcaaagatttccttagccatcgtgatgttggcaccactgttcgaattggttacccccggaatggccagggccactacgacttgcgggttatccgacggggagtaaccggcaaaggacagggtggtcgtcgccgtggtaccgtagtaggtttcggccgtcccggtcttcccggagattgacggcgtttcgctcttaagcgaggaggcggttacgtacgggctcgtcccgtgggtaaccaggtagagcccctctttaaccacgttaaaggccgccttacttgccggaatcacttgttggacctgtggctgagtggtgtacttaaccgcccccaggctcccgttggacttagtcccccgaatctgggaaaccacgtacggcttcatccggtaaccaccgttggcaatcgtcgacatgtactgggctaactgcaggaccgtgtactcatcgtagttcccaaacgattcgtccagggccgacccaatgtgggactgagttgacggcccctcgtagccggccgattcgcccggaatgtcgatcccggtcttttggcccaggccaaacatgttgaagtagtaacgtaacttcttaaagatcgatggcttcagggtgatttgggcgccggagtagtacttcatgcccccttctttcatcgccaattgcatcatgtaggagttagaagaaacttctagggcggtggaggcggtcagggaagtgttggccgacccggtcttgttgaaccaggaggccttagccgacgtcccggccaccttgattggcatatcggtcaaggtgttgttagacggggtaatcaccccgtccatcatggccccgaggaccatggcccccttaacaacggaccccatcgtgatcgggtggttgattccccccacttcatcgacggtctgcttcccggtcgttgggtcacgatcaattccggccatggcgtaaatcgccccggtgttggggttcatcaccacggcgtaaacccccgtcgaatacccattaccggctgacgagtagttcttggtcaagatcgattggacctgcttttggaacttagcgttgatcgtcaagaccaggttgtcgcccttcgaaccggcgtacttaaggaccgacttcgccaccgtcgagccattggaggtcacttcggtctgcgacttggaacccgccagagtcgactggtattccttttcaatgtaggattgacccaccgaatcgttacgggaatacccctgggaaagcagggtgttgatctcatcggccggcagccccgaggtcgtcaccgtcccggtcatcgtctggaagttcttcccctgcgggtagtttcgcgtccaggcggtcccgatcttcacccccggcatcgagctcaagtgttccccgacctcggccaattcctttgaggtcacgccggtttccttgatgtaggtcgtggaaagcgagtaggccccggtcatcgtggcgtaaatcatcgccttgttcttttgcgaactggttagcttgtactggctcgggtgggcgttgaggtacttgagcaccttgttgtactgactggttgagatcgtatcggcggtgacatccttggccagccccgcctttttgatcatccggtttaagttatcgtcattagccaggaagtaatcctgtttgtttctcgtcgttaacttctccgttgacaccgtcaggtacttgcccaactggttggcgatcttgtacatatcggcgtcggtaacgtcagaccccttagtgtaggtaatggcttggtgagcctggtttcctacgatcaccttgccagtggaatcatagatcatcccccgctgaacgttgttggtttgaacggtcgtatccgattctttaacatccgccttataggttgccccgtttaaaatctgcaggtaaaacaaccgaatggcaagcatcaagaggagcagacccacgatccaaagcaacaagtttaaccggaagggaatgaccgactgggcactccggttcttgttttgtgtccgcgggccaaggatcctcttaaagcgtttaaaaaaattcactgcaaaactctccttagccaaaattagtacttattttagcaactccggcaaaccctttgccggtctaactactagatgatactctttttaaggttgcttggcacctctttgaccacgatttaagcaaattttatgaccgatttcttcaccccaccggtatataattgacagcataagttgtaatggaaaggacctaaccgttttgcatattcaacgtcgccatcgtcggctctggctgacgattagttttttcctccccgtcttgttaatggggggatactttgcctaccgggggatggccccctttggttcctcaagcatcctgaccgttgacctcggccagcaatacgtcgacttcttttcctacttacgttcgacgttgctccaccaccccaccagcattttttactccttttctaagggcctgggcggtgaaatgtggggaaccaacgcctactacctgtttagcccgctgaacttaattctcctgccctttgccggcaagtttttgtcagcgggaattctcattttggtcttaatcaagtacggcttagccggtctgtccatggcctggctgctcgaccagaccactgagcaacacggcgggcgcctgctggccttttcgaccccctattcgatgatggggtggatgatcgccaaccaattaaacgtgttgtggctggacgtcttatggcttttgcccctcgtcatctacggtctattagctattttagacggccgcggctggcgcttttacctagccgccctggccgtgaccatgattgataactactacatggcctggatggtcgccctctttaccctgttgtttgccggctggtatttgaccaccaccaaggagccttggcgcccccgggtaacggcgttttcccgttatctactggcttcgatcggcgccaccacgttagccgccgtcgtcttgttacccgccgtatttgccttaaccaagagcaaggggacttacacctcaacgtcggtctcgtttaagtgggaatacaaccccctcaagatactggctaagttcgtccccggctcctttaacttcgaccagatgccaagcgggcagcccaacatctacgttggcatgctgatggtggccggcttcttagcctacctactgagtcgccgcgaccgctggccggcacgcttaagcgccctcttggttaccgcctttttggtggtttccttcgtctggtcacccttagaccttttgtggcacctcggccagtacccggtctggtacccatcgcggttctcctttgtcttttgcttctggctaatctggttggccgcccggactcttgaaccgggaacgaccttctcttggccggtcgtcttgggcgtggccctcatctttttagtcggggcgttaccgctgtttttcaactgggtgggctccgttaattacatttctcaaaatcagctctggatcggggcgggctttgcggcgatcgcggtggtgattttaaccttgcagcgccaaacctcccccgccctaaccgacgccttgatcgtcttgctcgccgtttgcgacgtctccacgagcgcctttaccgccctgaataacatctcctacgtttcccaagccgaatttggtaactacacagccaaacttgatgcggcggttaacacgattaaaaagggtgaccagggtctttaccgcatcgctaaggacttcatgcgcaccaaagacgaccccttccaggccgactacaacgccgccgatcacttcagttcgaccatggaacccagtgtttctagcttcgtcggctcaatcggtcagcccgccggggacgggtttatcacctacaccaacggaaccgaattgaccgattcactgctgggctttaagtactcactgacggccaacaataatggtaagcaggccggcacccaagtcttaccgctgaccagcgcccgctacgactgggaccgtcaaactaccctgtcttcttcaaagctcatcacgattaagaaaaacccgaccgccctgccactcgcctttggggccagcgaccagatcttgagcctctccaaaaacacgttggacccactcaactaccagtcgcaaatttaccaagcactggccggcaagtcgactaacgattccttatttaaggtccaaaactttgatcacgttaccttcatcaacctccacgagaccacccagattaccggggccgtcttaaccaaggttgattcagccgccccggccgccatccggctgaccttcaagccgacgactaacgacccctactacctgaccctggggaacgggatcctagacagcgtgaccatcacccggaatggtaaggccctcaatcaatacgacacctaccgtgacaccgtagccgtttcggtggccgaccacgccaagggcaaatcagtcaccattaccatgacgctaaagaaaaattcggcctggctccaaaacgtcagcctgtaccggctcaaccaagcctcctttatggctgattaccacaagctggcccaaagcccgttaaagattactaactactcgtcaaccaagcttagcggaaccgtcaagctcaagaagggagccaccaccctgatgacgaccatcccggccgccgccgggtggcacgccatggtcgatggtcgccccgttaagttacacaaggtcttaagtaccttttgggccctgaaattgaccccgggaacccaccaggtgaccttctactttgtgccaccgctactaatctggggcctgctcattagcctaggcgccttcgccgctttctttgccctcccgtggtggcaaaaagtaacagctcgccgccggtcctaagcacatttgaacctaaaaaagcaccgcccccactggagcggtgctttttgcttacttaacggacaggatcttaaccttcatgctgccgtttggaatttcattttccacggtgtcgccaaccttgtggcccaacagccccttggccattggtgattcgttggaaatcttaccggacagcgggtcggattcggattcaccgacaatcgtgtaggattccggttcttcatctggcaattcttggaaggtaatttcacgccccatcgaaacttcgtcggcggcaacgtcttcgttgtcgatgatgacggcgtattgcaacatcgtttcgatttggctaatccgcccttcaacaaaggcttgttcgtccttggcggattcgtactcggagttttcggagaggtccccgtagctccgcgcaatcttaatccggttaatgacttccggccgccgaacgagccgtaagtcttctaattcttgttctaacttggccttcccgtcggcagtcatcgggaagcttttttcttcagccattttctgcacccctttttattaaaagatcactagcaaactttaccacagtgccccggttgctttcaaccagaactaacctaaattagtgtgaccgcgtttgaccaagatatcgcggaccttggttgacaacaagtcaatggccacccggttctcgcccccctcgggcacgattagatcggcgtagcgtttggttggttcaacgaactggtggtacatcggcttaaccgtcgctaagtactggttaatcaccgagtcaagtgaccgcccccgctcctggatgtcgcgttgaattcggcgaatgatccgaatgtcgtcatcggtatcaacgtagaccttgatgtccatcaggctacgcaaccgttcatcatcgaggattaagatcccctctaagatgatcacgtcttggggttcaacccggacggtttccgtcgaccgggtgtattcctcgtagttgtaaaccggcatgttaacggcctggttgtggcgtaactggttgagttgttcgtacaagagatcactgtcaaaggccagcgggtggtcgtaattgaccgccttgcgttctgccatcgtcatgtctgcttggtcgttgtagtaggtatcttgggtaatgatttgaattgattggccgtttaagttatcgtaaatggctttggaaacggtggtcttcccgcttcccgagccgccggtcaccccaatgatgatcgggcgtctattttcgttcatgaatgctttcctcatttcttatatccgccaaagtataccagagggtctttcatcgggcaagtggcgcccgttgtccacgcgaagggccccaggcgtcggcaagccaacgtactggggcccaattggtaatttttaacgaatttctgcttggacttggtcctttaagtgggcaatcaccttgtcaaaggcctcgttaacctggtcttcggttaaggttccttgatcggcttggtaagtcaaggtgtaggccaaggatttcttattagcgggcaggaagttccccttgtacaggtcgaagaggtggacggccttcaggtacggtccgccgacttctttgatcgccgtcacgatttgggcgttggttactttctggtcgaccaagagggccacgtcgcgcgtaatggccgggtacttggagatcagctggtagtgcttgtcgcgcttatcggcttgcagcagtggttcgaggtttaattcgaagacgtaggttaccggaacccggtactgcttggccacggtcgggtgaacctggccaatgtaccccaccacttggccgtctaacaagacgtcggcacaccggcccgggtgtaaatcggcccggtcgtggttcgcctgatagctaatttcgccttccacggccatgttacgcaagtagcgctccacgatccccttaacggtgaagaagtcgacttggttatcgtcgtctgcctggttccaggaggcggccgtcaaagaaccggtcacggcgccggcgatgtgctcttcttcagtcggccgttcttgaccagccaccggcaagaagacccgcccttgttcgtaaagggctacgttgtcgacttggcgagcaacgttataggcaatgtcgatcaacaggccggccacgatgttcatccgggtcgccacgtgatcagaactcatggggtaatccaaaagcatcggctggccggcttgcgggttcacttggaactgggcggcttgttcggcagtcagtaaggagtaggagatggcttggtttaaaccgaccccttgcattacgtgccgcgacgcccgtaagaagcgttgccgttcgtttagcccccccagcgtctgggtgccggtcggcagggttgacgggatgttgtcgtagccgtacaggcgggcaatttcttcgtacagatcggccttaatggcgatgtcccagcggcgggccggcacttgcaccagcagccggtcatcgtcaagcgcctggcttgcaaagcgcaggcggtcaaagaggttcaccaagtcagcttggctcagtgacaggcccaagacgtcgttgacccgcttggtggataattcaatcggcgttacctgaacggcttcttcggtcgccgtaacgatccccttggtgacttccccgccggccagttcgctcagccagtaggcggcttcgttgagggccacttccaccgtttccgggttgatcccccgttcaaagcgcatggaggattcggagtgcaggtctaggcggcgggcctgcttacgaaccataaccgggtcaaagatggcggcttccaaggcgacgttgacggtttggtcggtaaccttggtgtcttggccccccatcgtccccgccagggcggccgggcggtcaccgtcacacaccagaatgtcttggctagccaggatctgttcttccccgtccagggtggtgaactgctcgccctccgcagcgtgacggaccttgatttcgtggctggtcaagcggtcgtagtcaaaggagtgcagcggttgaccgtacttaaccaggatgtagttggttacgtccaccacgttgttaattggccggatgccggcgttccacaggcggatttgcagccacaggggactgtcttgaatgtggacgtttttgatcacccgcagcttgtaagtcggcgccagttgttggtcggcgacggtcgccttgatcaggtcggcagtccgttcggtgccgttttcaaccacttcatggctggtgaaaccattgtccagggcgtaaatggcggccaggtcgttgacgttaccgtaaattgacagcatgtcgccccggtttggcgtcacgtcggtatcgatgatcgtgtcgtccatccccaggtatgagaagaccggcgccccgacttcggcgtcgtccggcaggtaccaaaggccctcttcgtaggcctttggtgctaccttatcggtgaagccgatttcttggagggcacacagcatcccgttggattcttcgccgcgcagcttgctcttcttaatcttagtgccatcggccagcttggccccggccagggcggtgatcaccttcttaccggcgaccaggtttggcgccccacacacgatttgaacggtcgtgtcttcggccaccttcacctgggcaatgtgcaagtgatcagattgggggtggtccttgatcgattcgaccaggccgaccaccaccttttgcaggccgttttgcggtgagtatacgtcgttaatgtccacggaggtccgggcgatcttttcggctaactccgtcggggtgatcccgttttgttcaagcggcaagtagtggtttaaccactggtatgatactttcattcaacttatcctttctggtcaaactgggtcaagaagcggacgtcattttggtagaagtcgcggatgtcttccaccccgtacttgagcatggcaaaccggtccgggcccagcccaaaggcaaagccgccgtaaacttccgggtcgacgccagacatcttcaagacgtttgggtgcaccattccagcccccaacacctcgatccaaccagtccccttacagattgagcaaccggcccccaggcaattaaagcaagtgatgtcggcctcgacggacggttccgtgaacgggaagtaactcgggcgcagacgcaccttgagctggtcgccaaacaggttttgggccaccacctctagggtcccctttaaatcggccatcgtgacgtgttcaccgaccacgattccttcaacctggtggaattggtggctgtgggtagcgtcatcggtgtcacggcggtaaaccttccccggtgagatcatcttcaacggccccttggagaagtcgtgttgttccagcatccgggcctgcattggcgacgtttgggtccgcatcaaaacagacggggtcacgtagaaggtgtcttgcatgtcgcgggccgggtggtcctttggcaggttcaacttttcaaagttgtacacctcttgttccacttcgtcccccacggccacttcataccccatcccgatgaagaggtcttctagttggtcgatgatttgttgtaagacgtggggctgcccttgggccaccggggtccccggcagggtcacgtcaatggcttcagccgctaacttcgcgtccaagaccgccttttccagttgggcccgcttttcttctagcgctgcttttaattcgtcgcggatttcgttagcgaacttccccacctttggccgttcgtcggcggacaggtccttcatcccccgtaagactgaggttaacgggcccttctttcccaacaacttaacccgcacgtcattgacccggtccaggtcgtcactttgcttgatttcttccagtccttgctggcgtaattcttccagccgctcctttaagctcataaaagcctccttgttttcgatggtaaagaaaaagccccgtccaaaaagggacgaggcttcgcggtaccaccctagttcttgacaattgccaaacacttttttgattggtaacggtaatcaaccgggtacaagtaccgactccggaagtgaaattcgctgctgaagtagtggttggggttccagttactaccccgacctccctgaaactacttgtgacagttactagtttccatcactgtctttttaaacagttaacattgtactcattgccactgccttggtcaagggggttagcaccacttatcgctccagttatgaacggccgccattacgggggcgaggtctttcccctgttcagtcagcgagtaatcaacccggctttcccccgggtaggtattacgactgacaatcccctcttgttccagttccttgagccgttcgcaaaggacccggtcactgcaccggtcaatgctagatgctaaatccttaaaccgttggctttcttcgtgtaacaaaacttcgataatcaacccgttccacttcttgcctaaaatggaaaaggtgtgcgaaaaacggggacacaaacagaaggtgtcgctccgttccatcgttgcttgatccatacaaatccccctcaaatgattaactaattcgggttgccttcacccgttcacgacgcttgcgtaaacgtgcccgcactgggccaaagaattcctgctccgcttcgtaatcatcaacaagggatacaatcaaactttcccagtaacgggggacggccacggtggcgccaaacatgtgctttaaaataatgtctttttccttgttggaaagcgacgtgattttttcggcattacgaagggccacccgggggtggatgaaggcatgcgtccccaagtcgaacttggtcgtccgccaatcgtagtaaaataaatcgtgtagcaaaccagcccgcgccgttgcctggtaatccaggtttagacgtttcgccagccggtaactatcgtaagaaaccgcgattgaatgttgcaagcggttggagtggtggtgttgcgtgtaattagctaacttttggaccgctggttgttccagcaggtcactgacaagtgcaacgtattctccgtcctggcgccattcgttctttgatttcattaattgcattacccctttgcttgctttagtttactttattgtacacgattcctgaacaaaaggggagttaattgtcctttgtttttgtaagtaaaaccaaatttaaccggatcttaaccgtttaacgcgtcggccagttcaaacatcaaaatgccggccgaaacggcgacgttcagcgattccgcttggccacgcatcggaatgtagaggttggcggtcgtctgtttcaacaactcctcgctcatcccgcgtccttcgttacccatcaccagggcaaagcccccctgcggcgtgacgattcggaagtccttcgccgccgggtttaactgggtcccgtagaccgggtacccggcttgtttaacgtcttcaaaccacttctttaagtcgccctcgtacagggccaagtgaaactggctcccctgcatggaacgaaccaccttgggggaaaacaggtcggcgctcccgtccccggcgaccacgccggcaaagccagcggcgtcggccgtgcgcaccatcgtccccacgttccccgggtcctgaacccggtctaaaaagagccaggccccgctcaggtcggtggccacctgatgcagatccggtaggtcggccaccaccatgatcccctggggggtgaccgtttccgtaacggccgccatgatcgccggggtcacggaatagacctctttaaagcgtgctacaatatcagggtgagccgcgagttcttctttagtgccgattaactcgtgcagaccgcggtcggcctgaagggcttcgttaaccaggtgccacccttctagtaggtagcgcccctgttgcttgcgtccctttctggtctggagcttcttccactccttaacccgggtgtttttgaccgacgttaattcctctaccaattctttcacctcaaaatccatttccattcatcttaccacgaacaacacgaaaggacgatcttaccatgattaactaccacttacttgttgccggccgggtgcagggggttggctttcgctgggcgacccttgaaattgctaacgaactgggcctggtcggctgggtcaaaaaccgcgccgacggccaagttgaaatcgtcgttcagggccagcacgcagcggtgcgcacctttttaaaaagaatccaagctggccccaaccgctgggcccaagtcgaccgggtgcaagttaagcaagaaaacctcgccgacttcgccgatttcagcattcgagaagggttctagtggtattagagccttctttagggtaagattgttcttatagtgatttttgaaagggaactttaacaaatgaagaaaaaacgctttttggtcgccgggggcctaacgatggccctcaccctccttagtggttgtgtccgcaccaccaagagtgggaagccatacggaatggtttacgactacctagccaagccaatgcaacacctgatggaatggtttgccggcctctttggcaactcctacggttgggccatcgtcgccctcgtggtggtggtccgcttgatcctcttgccgctgatgatgagccaaatgaaaaagtccaccatgatgcaagagcgcatggcaatgctacaaccacagatgcgggcactccaggaacggcaaaagcaggcgaagacccccgaagaacaggcggccgctagccaggccatgatgtcgttttacaaggacaacaacgtctccttaaccggtgggatcggctgcttgcccctcttaattcagctgccggtcttttcggccctctactttgccatccgctactccccggacctggcccaagcttccttttttggcctccagctcgggcaacggagcgccctgttagccatcatggccttcgtcgcctacctaattcagggctggctatcgatgctaggcgtgcccgaggaccaaaaaaagcagatgcgcatggccctgatgatgagcccgatcatgatcctcttcatctcttggcaagcatcggccgggttaggcctgtactttttcatcggtggggtgtttgcgatcctgcaaacctggttggttaacatctaccggccacggatccgcaagcaaatccatgaagaaatgaagaagaacccaccaaagccggttgagccactcgttaccaccccggctagtgcggccccggccaagggtgccaccagcgccccgcgaccaaggaaaaaccgcaacgccggcaagcaacaccaccacaaataacaacggtaagtaaaaatagctggagatcaaagccacgatcttcagctatttctttattacttacccgtgtattaagtttagtcgttgtcacacccaactttgaaaggagcttttcatgatttaccccatcaaccacgatcaacaagtcctccagcaacccgcccggccggcgacaagcgccgaccgccaattagctgaagccttggtcgccaccctcaccgcccaccaagaccactgcattggcatggcggccaacatgatcggctttccagtctccatcatcgccgttagcctcggccccgttaacgtggcgatgctcaacccgcggctggttaaaaaagcgcacccctaccaaaccaaagaagggtgcctatcgttaaccggtacccggtcgaccacccgctttgaacgaatcacggtcgcctaccagggcctgacgggagcacaacaagaactcgaactaaccgggctggccgcccaagccgtccaacacgagtgcgatcacctgcgggggatcctgatctaaccccgcctccttgaccaccgccgttacttcttgctagaatcacagctgaaacaaatatggaacgttggggtcgccgggtcccacacaaatttcactaacgacttgcttacaggcgcccacttgggggaggcagtctttaaaggagttagaatcgctatgaccaacacccccaacatcatcaaggaaagtaatcactacatcacccgtaacattgcggcctcactggggctttcaatctacgtaatcatcgataccctcttcatctcaattgccgccgggccgctgggactgaccgtcttaaacctggccctccccctcttttcggcctttaacgcaactgggctcttattgggggttggtggggcggcctactactcgttaaacaagctcacccaccccgagcgggtcgagcacttgtttagccagctaattatcttcgtggctggactggggatcctggtgaccatcctaatcaacctctttgccaccccacttttgcacctactaggagccaacgccgccaccttaccaatggggctaacctacgtgcggatcattagcctggcggcccccttttacatggccaactacattgtggtcaacttcgtcagaaacgacggcaaccctaacctgacgatgatcgcaactttaaccgaaaccaccggggtgatcctcgtcgattggctgttcatctttggcctcggtctgcatatggaaggggcggccctcgccgtcctcttttcaccggtctgcagcctgacggtactgtcttttcaccgccgtttcaagggccgccagctccactggtactggacttggccgcgcctgaaaagcgtcgccaccgccgcccggcttggggttgccgcggcctctaacgaactggctaatggggtttcgatctacgtcttcaacctcgtcttgttgcacctggctggtaactacgccgtggcggcctacggggtgatttccaacatcgcgattgtgacgattgcgattgccaacggggttgccctcggggcccagccactaatctcacgcgaagtcggcgaccaccgcttcaccgccggcaagcagatcctaaaccacgcctttaagatcaccattagcctggccctcttattaaccctgattttagtcctgtttaaggggccgatcatcggaatcttcaacgccgagcaccaggcccaactggttaagtacgccacggtggggttaccaatctacttcacctcggccgtcttcaccgccatcaacctgatggcaatcatcttcttgaccgccatcgggtcctcgcggtttgccttcgtcctttcctttttacggggctacttgatcctcatcccaatgatcattggccttggggccgtcctcggcattaccggggtgtgggcggccgtgccgataaccgaattcttagtgaccatgctcgccctgcttttgatcagggcccgcttaaaagaatggggacactaaaataagagcctgggagaaaacacggttttctcccaggctcttattttatgctcgaatgttagaccaacacgtggcaactaaccgccggtcggctgcctaagcaagccgaagaacggtgcgtgctacaccatcctccccctcttccggccggcctgccggaagggttatttaccactttccttgtttttggcttctttttcgtcacctggttccacgatcggcagggtaatccggaacagcgaaccggaccccagctggctttccaccgtcaccgttccgtggtaaccctccaccaggcgtttggcgatcgccaacccgagtccgttaccacccttcttacggctcctggccttatcaacccggtagaagcggtcaaagacccggtgaagatcctcttgagaaattccttccccaaagtcttgcaccccaatctcaacggcccgcaggttccgggagagcgacaggtggatttccttgcgctcgttggagtacttaacggcgttatcacagaggatgatcagaatttgctcgaggtgatcccggtaaaccggcaccaagacgtcctcatctaggtcatcatccaggctgaagtgaaagtccgggtgaatcatccggaagttatcgtagacctgattaaccagctttttgaccggcgtggtggcgtttctaaagttaacttccacctggcccgcccgggtcaaatcaagcatttctttaatcagggtgttcatccggttcgtttcggctagggccgcttgaatcgattcttccagttgcttggggtcatccttaccccaccgctctagcagctgcatgtgcccctgaatgatggccaccggggtccgcaattcgtgggaaacgtcgcccacgaactgggactgttgatcaatgtagcgctgggtgcggtcgatcatttcgttgaacatccaggccaattcacctaattcatcgttccgactggtgaccggcacccggcgattcttggttgggtcatcggacaagacctccaccgtttcctggatgtcatttagcggtcgtaagaggaagtaggataagaagtagcccatcaggcccgaaaagatcaccactaagctgagggccaaaattgagatcagttgtaggcgccggtagtgctggaagtaaaattatccaggttgttttccacctgcaggtagccgatcacttggtgggtcttggaactgcggatcggtacccgcccgatcaggtactggtgctttttgccactcaccgttttaatggtctgctcactgaccttttgaaagccctgattttcctccccggtggcaaagagatccttaccactacggttataaaccgtcacggtcaggtggccatccgacaggccctggacaaccgggcggcggtatacctttccacttcccgcctccttgggggttagggcgttgtccttgagggtttggtcaactttacttgcggtgagctcgctctcagacgcctggcctagcttttggctaatggccattaacgattgggttagcgtctggcgttcttggccgagcaagtcctgggtgaatgaagagaacaaaaccatcaccaccgccagcgagatgattaacgaccccaacgccgttcccagggcccactttaatttgagggagacgaagcggttcccccgctttcgttcgtccattgccaccacctacctaggagcggataacgtaaccggtcccacgaacggtttggatgtagctcttttcacccggccggtcaatcttgttgcgcaggtaacgaatgtagacatcgaccacgttggtttccaccttggaatcgtacccccacaccttggataagagttccttacgagacatgaccacgttaatgttttccatcaggatcaagagcagttcgtattcacgcttggtcaggttgatcacctcgtcgccgcgccgaaccacccggttttccttttcaatcgttaggtctttgtaggtcaccgtcgtttggtgaacgctgttggcgtcgccttcaattgaaatccgccgtaacagtgcccgcacccgagccaacaattcttcaatggcaaagggcttaacgatgtaatcatcggccccgtggtccaggccagagacccggtcaatgaccgaatcccgggcggtcatgatgataattggggtgtccttgacttcccgcacccggcgcgccacttccagtccgtttaattccggtaacatcagatccaataagatgacgtcaaaatcctggtttaaagccgcatctaacccctggcggccgtccagttcaacatccgtttcgtaaccatcatgcttcagttctagttcaacgaagcgtgccaggttttcttcatcttcaataattaaaatccgactcatatctttttctccttacaatcgcacactatcctaatttaactatcgcctattttatcatagaactctcattaaccctagtaaggattaatgcaggattcccctcctataaaaaaagggcttccccaggtccggcgcctaaggggaagcctttttgatttagttgttttcaacaacttgcttgccatcgtagtaaccacaacttgggcaaaccatgtgggacttacgaagctcgccacattgtgggcaaggtgctaagcccggaacagttaacttgatgtgtccccgacggttacgcttacgggtctttgatgtcttccgtgctggtacagccatgtatgacacctccttaaaaatttttatccactagtggtttctaaccgttcgctaatcacggctatcctgatcaggaaataagttctttaacttagcgaaacgtggattaacttgattagtctgctcctcatcaagggttgcctcatcgaccattgaccaccccttcccctctggcaagcgctcggcggcttcttcagccggcgtcaacacccgcagcgggacctgctcaatgatgttttccatcacgatttcatctagatcgatgacgccggaaggaccaagggtcaagaccagttgatcttcttcttcgtagcgcccgcggtgactatcatccggcaggtaggtttcagtgatcgtaaagtttagtggcaactctacgggagcaagggatcggcttgagggcaccgtcagcaccagctcaacgcgggcactaagggtggcatcccccttgtcatagcttaaataaccatcgaccgtgactggcgtggccgccagaacggtttcaggaaaccgatcggtcagtgatgcgttcagatccaaagtactattaatgtgcaatggctcatcttggtaacgatgtaagtcagataatgcccacttcatggtactaacctcctaatgcaacgtgcctaattatacccgggtccccgggcattgtcaatggtttttccttgacaccacacggcttttacaccaggcgaattggcccccgggttaaatcctgctccggggtgccgaagaactgatagagcttgcccgcccggtagtcaagggccaattcggcgtttttcatccgctggtttaccttggtgattaacgggtaggacagctcctttttgacctggtgcaagtaggcctggccagcggccgtgaaacctaacacccggtggtaggggtggtagttggccatgtcctggtcggataagttcagtgtcaagtaaaaggctacccgcatcagccggccgtacgtgtagcgcttggtcttgaccgcctttagaaaggaggtgaagccccgatggcgttccgcggcctccttgagccggttctctaagccttctttgacctggtaagtttgttcaagtaggggcgccggcgtttgaatcaagtggttggctaagagcgggtagagttgctcccagttgggaatcgtcgttagcttggccagggcgctagccgtttgggcgggtaccgtttccgtaacgtcttggtgccctttaaccgcctggcggatcgcaccagccgatgagatcgccccggtcaactgctgatcggcgtaatggttatcaacgcgctggatcggctgtaagtgaaagccaaagtccccggcggccttagcccggtggtaggcaaaggccaagatatcgttgggatcggttagggcatggccagtcaccgcttccagttgctgattaaactgggtggcgtaggtattgttgaactggtggaaggcggcctggttaaagtcttgctcggcttttaccatcgccgcaaagtcccagtccgggtgctcggcaccaaacaccacgtcggcaacttgtaaatcgtttagtaacgataaggcccccatggcaaagcggtgggccggctgaacggcgtcggcaaccggtagctccaccactaggtcgaccccgttttgtaaggcggccagtgtccgggaccacttatctaaaatggtcggctccccgcgctgggtgaagttccccgacatgacggccaccaccacgtccgccccagtcaggcgcttggcctgggctaggtggtaacggtgtccgttatgaaacgggttatactcaacaacaagtcccacggccttcatttaatggtcccccctttttggcagacgaaaaaccaccgcgtcgtgtcatccttaacctcgtggcggccaaagtcggcgctgacttggacctggtcgaagccagccacctttagggccgtcaggtagtcggccagcgggtaggtccgctcaaagtgggtttcactcaggcgccggtagctgccgtcgccctgttgaatgaagaaggtcaagtcgtgaatgacgccgtgagccacctcttcgtcggcaaagctttgccacatgaaggcccgggtgtgatcctcgtcttggtaattaaaggagtaacccgggtaaacctgatcggtttggtagggggtaatcacgtcaaacaagaactttccgcccggtgccaagtgctggccggcctgcgtcagggccgcgttcacctgcgctaggtcatttaagtagcacagggagtcggcaaagcaagtaatggtctgaaactggcccaagccggttaggtccaacatgtcggcctccaccagggccaggtcaacctgagcactttgggcgtgctggtcggccaatgacagcatctccacactcaaatcggcatcggtgacggaaaaaccctgcttggccaggcgaacggccaggcgaccggcgccccccgctaggtctaacaaggtccccggcgcttgcacctctcgcatcacaaacgactgccaatcagcgtagagctggtcgtcaaatagttcgtcatacagttgggcgaaggtctggtaaatcatttggcttcaacccaggcactcaggttcaccagtggcgcttcggcccacagcttttccaagttgtaaaattcgcgggtttcttcgcggaagatgtgaacgaccacgtcccccaggtcgaccaggatccactgggccgcttccttcccttcgacggagccgatttcaacgtgttgctcgtgggccttttcgacaatggcgttggcgattgcctgcacttgacgattggagctcccggtcatgatcacgaagtagtcggccatcaggctgatttggtccacctttagggcgacgatgtcttcggcccgccgaccgtccgcggccttaacgaccatttctaataactctttgctttgcatttaatcttcctttccgttgcttggcacccacgcgttgtaggtcgccagagtagttggataaacgggcttgcccgttgatactaagtacatcagggtttgtttggtttgcaaggcgactcccttggccaggctttggtgggtgacctggcgagccagttcaaccccctcaaaatcacgccccggctcaatgtagtcggccatgtaaacgatctgggctagcttggtcatgtacggcgccccgaccgtgtgctgacgaacggcgtctaaaatccgttggtcgtggcaccccagttcatcggccaccagctcggctcccactaccccgtgccaaatggcgttgccgtagtttaagagtacgggatcaaggtgcttttccttaatcgttgcaatgaagtcttggtcggggcgttgcttagcgtaatcgtggcacaaagcagcgatgctagctagttccaggtcgaccccattttccttggccaattcgatggccgtttcttcgacccgcaagacgtggtcaaaccgcttctttttcatggcgtggcgaagcttatccaccaattcggcacgactcagcggcagtaactgttggtgatactctaattcgttagtcaatgtataactgatgctccttaatgtaatcctcgacggcgcgtggcaccatgtaacgaatcgactggccagacttcacccgggcccggatgtccgatgacgagatggcgaccgtcggcacgtcgacccagataaccgggtactgggcctcgtttttggcccccttgcgccggacccccacgaggttaaccatctccaccagttgatcgatcttgttccaggttggcaggtagtcgaccatgtcaccaccgataatgaagtagtaatcggtatccgggtgacgctcctttaaggccttgatcgtatcgtaagtgtaggaaacgcccccgcggttaatttcttccatttcgatgtcaaaaaaggggttatcggcaacggccaacttcagcatatccacccgtagatcggcggcgatcgtgcccttgtgatcgcggtgtggcggttgcatgtccggcaagaaggagaccttatctaaggacagggtccgcccgacttgctcggcgaccaataaatgggcgttgtgaacgggattaaaggttccgccgtacaaaccgacccggcggtgcctttccgctttaacctgttggggttgaacctttgggataacgtttaccactgcttgcaccacatttcaccccgcaatctagattttagccacccgcactgagaggtcttggaaacgggggttttcggccaccttaaatagcaccaggacccgaccgattacttgtaccacttgaatctcactgttttgttcgatgtagtccttgacctcttgggccgtggcgtcactgttttgtaagatattcaccttcattaactcccgcttatctaaggcgccggttaattggtcaacccaggccggcgtcaagccgtttttcccgaccgcaaagagcggctgtaggtgattggcttgcgcccttaaaaagcgcttttgctttccgcgtaaattcatttaattcttcctcactttctatatcatggcccgccgtactaagacgccgacgcccttcggtgcccaaccagcaaccaccagccccgctgggacggtgatccagccaagcccttcaaagaccaggtccgacttttccgtaatcgcaaattcaaaccgttccaacggcgggaactgatcaatttcgttttgatgcggcggaactaagaggccgcccaaatgcttttcataaaaggcatcggcattggccagcttggttcggtgcagggggaggttgttgtcaaagtaggcggttagaccagcccgcggccccttcagatagtcaaaacgggcaatcccccccaagaaaatcgtctgctgctcatccagctggtaggtcttgggcttgatttccttttggggtgccaccagccgtaggtcctcagccggcaagacgtgggccatttgctcttggtggatgatccccggggtgtcgaccagttcgtgaccgtcatccagcggaatttcgatcttatcgagggtcgtccctgggaagcgcgaggtggtgattaggtcttccaccccggtccgttgcttaatgatctggttgatcaaggtcgacttccccacgttggtcaccccaaccacgtacacgtcgcgaccctggcggtacttctcaatcgtggccagtaattcttcgacctggtgattctttttggccgaaaccaaggttgtcatcagaggccgaatcccggcttggttggcctgttgacgcagccagtcggttagcttagagcggcgcagcgaccgcggcaacaagtcctctttgttcccgaccaaaaggaccgggttcttgccgacgaagcggtgcaggcccgggatgatcgagccgttgaagtcgaagatatccaccacgtaaacgatcagggcgttggcctcgcggatgtggctaagtaagcgcaaaaaatcgtcgtccgtcaaggaaaccggggcgatctcattatagtggcgcaagcggaaacaccgctggcagtataactcaccggtttccagccctttgttcagtgccgacgccggcgtgtagcccaaggcgtccttgtcttcggtttgaattaccgccccgcagccgatgcagcgcagttcttcgtccctatttaattccgtcattcaatccctcctgccaggtttgttcggggtacttctttaagaggccctttttgacccccttttccatcaagcggttgagtttggtattccactggtcactgtcgagtagtggccggaccaatatgctacggacgccggcaacgttagcggcggcgatatcggtcaacaactggtcacccaccattaccacctcgctggcttcaaggcccaggcgcgtcctggcccgggtaatgccaaacgaaagtggtttgagggcccgggaaacgaagggcaggttcaggggtgacacggcccgctccacccggcggtgactgttattggaaatcacaatcaaaggaatccccgcttcctttaaggacgtcatccagtcctttagttccttggttccgttcgggttattccacgcaatcagggtgttatccaggtcggaaaacacggcccgaatcccggcttccttcagttccgccggacgaacgtgataaatcgagttcaccatccacgttggtttgaatttctctagcacaattttctccttgtgtgtttagtcattaccaccattatagtaattgtcgcctggggcttcaatctaagtgaccatcatcttggcccgaccggtaaaagggcgacttagtgtactgactacgccggtacaacaagaacgcgtacaaaccgctgacgatcgtcaacaggaccgacgccccccaaatcgtcgtcgtcccccaaacccgttgtaagactgccgacaataaggcccccaggataaaggcgctcactaaaccggtgtagttaaccgccgccgttaggccctgtcgatccccttccaagaagtacgcacaccaaccggtcaccgccttttttaggttcccggtcgaaaaaaacgttgttataccccagcccttcaatcttatcaaaggctaggtttaacatcgccatcccaaaggctagcggtggcaccaccaggttattggaccaggtggtggggatcaaaccgatcaccaaacagattaaaattaccggcagtaagctgacgatgcgccactaatgggttcggtggtgaatccggaagtaggtaacggtcaccagtcctaagataaaggccacaaaggtccacaacttggtcaccaggcctggtaagttgtgttgcgctaattcaacactgaaaaaaatgatgttaccagtctgaccggccgctagcgtgttgccgcgcaagccataggtgtaagcatcaatgtagcccccgcaaaaggtgaaggcgagcgctaaccaacggtactggtataagtggtcacggttatagattggggattgctctttgatgacgttgcctccaatcgtagttaggtggtaaacaacaatggcccccagcagttcgaaacgaacattactggaggccaattgttaaaagcaagaaccgccccagagcggcctttgcctaatttatatcccgactaattgaattagttcagggccttcttagcttcgtcaaccacggccttgaaagcgtcggcgtcgttaactgccaagtcagcaagcatcttacggttgatgtcgatgttagccaacttcagaccgtgcatcagcttggagtagctcagaccgttcatccgggcaccggcgttgatccgggcaatccagagttcacggaagttacgcttgttcaccttccggtcacggaaagcgtaagtgtaactcttcatcacttggtccttggccgtcttgaataaacggtgcttagaaccagtgtaaccctttgctaacttcataatgcgcttccgacgagcgcgcgtaactgttccacccttaactcgcatagtggtatcctcctacaaatttaaatagttttcgctgtgcgtcccgcaattacttagcaggaatcatcttcttgtaacgctttacgttagacttgtccatcatggaaagaccacgcaattgacggcgttgcttcttggtcttaccgtggaaacggtgagaagtaaatgagttaccactcttgaaaccacccttagcggtccgcttgaaacgcttggctgcagcgctcttagtcttcatctttggcataacgaattcctaccttcttaatttatttttttgctttatcaagcggggcaagcgttaagaacatgctccgcccttccatctttggccgttgcacaaccgtggcgatgtctttggtttcctccgccatccgttcaatcatgtcccgaccgatatccttgtgggtaatggcccggccacggaaccgtagggaaacgcgcacttgatcacccttttcgatgaactttcgtacccgacctaacttaacgttaaagtcgttggtgtcgatcgtggggcttaagcgaatttccttgacggcaaccgtcttttggttcttgcgggcttcccgttcctttttttgcatctcaaaacggtacttcccgtaatccatgatccgcgcaaccgctgggcgagccttgggtgcaacaagcaccaggtcaaggccggcatcctctgcaagttgcaatgcttcacgcttggacttaataccaagttgttccccgttctggtcgatcaggcgaacttcccgcgcacgaataccgttattgacaatcattccttgagctatggcaacacacctccaatttgattagcgaaagaaaattaagcaagaaaaaacgggagtgcacacacacccccgcaaagcgaactaaccctaatggtcattcggatttaatctcgtcagcccggcgactccaatcacctaggcgagaagcgggtgcttctactttttctttcaacgtttactaatatactaaatcccccgcccgaagtcaagccctttgttcttgacggaggttacggccgctgaccgggacttctcgggccaaaaaacgaatccgttccataatccgcttagcctttaggggctcctggttcccttgggtatcgaccgccaggtgggcctctaactcagccatggtgaagttggaagagaaaaaggtcggtagctcctcttgcatccggtactccaagataacccccaagatatcgtcgcgtagccaggtcgataaagcatcggcgccaatatcatcgagcattaaaattggggccgccttaacccggtcgcgcttttggtcgagggtgttattggcgatcgcccccttcatctgcaccgcgaaggtggggaagtgaactaaggttgactcaaccccgcggccggccagttcgtttgctaaggcgccgagcaagaaggtcttgcccacgccaaagctgccggaaaagtagaggcctggaacaaagccttggttggccaagtaacggttcataaagtccgtcaccgccatgaaggcctgctggcgactaggcgaggtccgttcgggttccatgtaaaaggtatcaaacgaggcctggcggatgaacttgggcatgttgatggcttggacccggttaaggcgggcctcttgttcgcgttgtgcgtttaactgggcggtcggaacgtaggtcacggcgatttgaccgttggccagttcgaggcggggcgcataccccggggcgaccgttgcccggccggcgcgcattaactcccgttcccggtagaattcgtacagttttgagtagccgcgctcaatggtttcgaccgttagggagttcgcgttttgcgccagaaactggtggacttccgggtcgtttaagacgtggtcgacgagttgctggtaggcctggttattatcgcgggcctttaaagcggcgctaaccgcctggttgattgattgcatggccatccatcctttccgttgaccactcggggtcattgattgtggtgcggtttgttttcgctggcccggagtttagccagggcctctttggccgcttgaatttgttctggcgacgccacttgggccggttgttttgagtcatcctgcgcccaagcggggagctgttcgacaattgttttacgccggccctttttggaggtcggccgctttggttcgctggttttttgccaaaacttttggatcgccgctaccgcatcggcggccgtccgcacgccctggcgggtccagttattggcaatcgtgttgacgaagttaggcgctaaattggcgttgccttgctcaaccacaacgtagtaactcaagacgttaatcgccccgtcggttaacggcgtctggctaactagccgttctaaggtccgccgctcggtcggggtaacaaagcccgaaccagtcgccttcttgaggttcgttaggtactggagtggggcgccctgatcggcttctagcacgagggccctttcctggggcgtcagtgtccccgttttgtcggccggttggggggctggtttaaccggcactgtttcctttggttccgcccggttggccaccaccgccttaaactgttcggagtttagttcgcccgtggttaaatcggtggccgccaacagtagggtggccaactccagctccgtcaaaccgtaaacccgcttttcggcaatgatcaactggcggtgctttgatagttggtcgctagctaatccctgggcctgaacctggttggccaagaattgccagtcaacgcttggttcaggggccgttacccgtggttcgctcggctggcccaactggtccttacttgccgccacggtgtgctggtccgccggggacgtcagcggcttgaagacctcaaaaaagccctgggttaactcgtgatagtcatcggtagccaggtggtaacggttagccttgtccaccaactgctggtagcgccgttcccccacgtgttgtaaaagaacgacggcaaacaggtcctcgttaatgaattccgcggggctctttaaggcctgtagctggtaaatcactaccgggcccagctgatcgacccgaaagaaggtccgcaacagccccagggcctccagttggccgcgggcctggtcaatttgattaatccccacccctaattggtccaacaggacggtgtgctggtggcgctccgctggcatcgggttggggaccaaccgcccgctaagtgccaacaataagctaagcgccgtggggctaagtagtggttggtagtaatccaccaaccactcttgaactatgccggcataatccggactggcggcgacgaggtagccggtttgcggttgtagcttaaatggggtggtacccatcaacgctcctcctttttcatcgattcaatttccttaaagaaggcatcgacgtctttaaactggcggtagacactggcgaagcggatgtaggcaatttcgtcgaccggtttaagttcgttcatgacaaactcaccgatgacctgactggagacctcgttttcaccaaggcgccggacccgggcttcgacgtgatcggcaatcttggttagcttatccatgctgaccggccgcttttccgccgagcgcacgagcccgtttaagatcttttggcggttaaattcttcccgggttccatcctttttgaccacgagtaacggtgtttcctcgtatcgttcaaaggtggtaaagcggaagccacagttgacgcattcgcgccgccgccggatggacatcccatcttcagcggggcgactgtcgatcacgcgtgatccattatgatgacagtgtggacaaagcatcgaagttcctcctgatttcctgacaaatagtttcgtaaactatattataccacagagtgcaaatcggccccttcccgccagctagcaatcaacttagccacctgacgggcagtcttttccctgctcccgttgttatcaattaccacgtcggcgtgggccaatttttccgctaacggcatttgggtggcgattcgttccctggcttcttggctaccgtagtggttacgggccatcaaacggtgcagttgggtaagcgggtcaaccttgacgaccaccacctgatcgcaatagcgttggtagccggcttccagcaacaagggaacgtctaagacaactagcggcacccctagtcgtttcaacgcggctaggcttgcttcaaaaacttggcgaatcaaggggtgggtaatggcgtcaacttgttttctggccgccgggtcactaaagaccagttgccctagtttggcccggtttaggctcccatccggctttaaaatttgacgtccgaaggcccgggtcagcgctagcaggccgggactgtctttttggaccaccgcccgggcgacttggtcggcatcaaggaccaccaggccggcttggcgcaactgggccgccacggtcgatttgccgctggcaatcccgccggttaaaccaattaccttagtcatctggttccaccagcgcttggcagtgcggacaaaaagtcgtcccccgctgggccaccttaattttgactagcttggtgccgcagcgcgggcaagcgtcaccgctgtgcccgtaagcctggagttcattttggaattgaccagcgtccccgaaggcgtttttaaaggtgtggacggtcgtcccgtggcccgccgtggcccgggcgatttctgcgatgatgttttcgcgcaggcgcttaatttgatcgtcagtcagcgaattagccggttgctcggggttaatttgggtttgccaaaggacttcgtcagcgtagatgttacctaacccggccacgtgggactgatccaacaagaagggcttaatcttgctccggctcttcttgaggatctgcttgaagtaatcaaactgaaagtcctcttcagttggttccgggccgatcgttttcagcccgccgaccgtcatttcttccccggttttaaccaggtgcatccgcccaaacttacgggtgtcgcggtagcacaggtcggtgccgtcggtgaagtgaaaaatcacgtgggtgtgcttatcaacttcggcgccggtcggttggttaaagtaactcccctccatccgtaggtgggagaccatcgtcaggtcgttggaaaagcggaagagcaagtacttcccccggcggtcgattcgttcgatggtttggccgatcaaggcctggcgaaactcctcgacgtcattttcaatcgtcttcccgtaattgacgtcaatccccttgatctgacggccggccgcgattcgcattaacccccgccgcacggtttcaacttctggcatttctggcatacttaactcccctttttgtttataatcactctaaattatcaataaaaaaggcggactggcaagtaatttgcccaccgccctagcttattttttcaggtcgtaccaggttgccccggacttgctttccaccttcagtggtacgtctagctttacggccgagtccataatggaaggaaccagctcctctaaggtggcgatttcttcttccggcgcttcaaagaccagttcgtcatggatctgcaagagcatccgggcccgtaagccccgctcctttaaggccttttccattcggatcatggcaatcttgatgatgtcggcagccgacccctgaatcggggtgttcatggccattcgttcggcaaaggaacgctgggtaaaggacttcgcgtgaatttccggcaggtaacggcgccgatgggtcagggtttcgacgtagccctgctgtttagccagttccacgatgtcgtgaacgtacttttccacccccgggaattccttgaagtaactctggatgaattcgtgggcctgtgggcgggagacgtggatgttttgggctaggccgtaatcggaaatcccgtacacaatcccgaagttgaccgccttggcctgccggcgcatgttgggggtcacttcgtcttcgctttgcaagtggaagatccgcttggccgtggcggcgtggatgtccttgcccgccaagaaatcagcctgcatgttcttatcgccggtgacgtgggccaaaacccgcagttcaacctgcgagtagtccgacgaaaagatcttccaccccggtgccgagggggtaaaggcccgccggatttggcgcccttcttccaggcgaaccggaatgttttgcaggttcgggtcgactgacgagagacggccggtcgccgttagggtctgcaagtagcgggtgtggatcttttggtcgtcttggtggatcaccttgagtaagccggtgatgtaagttgattgcagcttgctgatttgccggtaggccaagatgtcttggacgatcggtgcccggtcggccagcttttctaagacgtcgacggccgtcgagtagccggtcttggtctttttgatgaccggtagcttcatcttttcaaataagattacgcccagctgcttcggggagttaatgttaaactcctcgccggcttcttggtaaatcgcctgttctagctccgcctcacgttcaactaacttggagcccatctcctttagggtcgctgcgtcgacatgaatcccggtgatttccatgtgggccaagaccgcggacaaggggcgttcaatgtcttcgtagagcggtagttgctcgttatcggtcagctgttggtataggggttctttaaggtccctaatcgcccgggcctttttggctaggtgggtgaaaaagacctcgtcgtcagccggaatggcccgcttagcacccttcccgtaaacctcttcatcagtttggacctggtggtaatcgtgggcggccgccagcacccctaagtcattggcgttttcactcgtgttgagcaggtaagaagccaagagcaagtcaaagtcgaccccggccaggtcaacccctaaccggtgtaagccgaccagctgggccttggcgttgaagacgtccttttcaaccgctgggtcttcgagtagcttctttagcggggcggtggttaataggtcggcgttacggctgactagccaccgcttgccatcgccaattacaaagccggccagtggtgattcgtggtagttagcgtccggcatttctaattgaaagcaaacggtagccccgagttgatcaaccaacgccatgttgtcctcgtctaacacctggtattcgattggcgcttggtcaacttgtgcgcccccttcttgggcgcctagctcctttaaaaaggacttgaagtctaattcttggtacaggtcaattagggcggcttcgtccggtccctggtaggcgatgtcttttaagccgatcgccagcggagcgtcccggcggatcgtcgctaggtcttggcactcccgagcaatcttttcttcgttgatcaggttttccttgcgcttggactttttcatcgcggcgatgttttcgtacaacccgtccaaagagccgtattcctgaatcagggagaccgccgttttttcaccaatcttggtaaccccggggtagttatcggagctatcccccatcagggccttcacatcgatgtattggcgtggggtgacgcccagcttttcttgcatgtatgccggggtgaactcctcggtttgggtcaccccgcgcttggtaacggccacggtggtgtggtcggtggccagctgggtcaaatcacggtccccggtcacaatcatcgtctcaaagccggcctggtccccttccttggccagggtcccaatgatgtcatcggcctcgtaattaactagttcgtaagcgtggaggccacttgcttcgaccagcttgcgtacgtagggcagttgttccactagctcacccggcgttttatcacggctccccttgtaatcggcgtacttttcagtccgaaaggtggtcttgccggcgtcaaaggccaccaaggcggcgtctggttgaacctcctttaatatgtgatccagcatcagtttgaacccgtagatggccgccgtgtgtaaccccgcctggttggtaaacttctccatctggttgtgcatggcgaaaaacgcccggaagacgatgctattcccgtcgattaataaaagctgcttagccatttttatccgtcccttcttagtcactgctcccattgtagcaaactttgcgccccgccgcttgtccgtccccttaaataaagcgcttgccatcgccttttgacccgggtatcgtaaggataaacatgaaattgagttgatacaatggaagttgcaatcaagagtgccggtcttaccttacgggggctgctcgaggggagcgaccaggtgccaaacgaccggatcgccattttaatgcacggttttaagggtgacctaggttacaccgaggagaacctcttaaaccaactggcccaccgcttaaacgaccagggcctggccacgttacggtttgactttgccggttgcggtaagtccgacggtcagtttagcgacatgaccgtgttaagcgaacttcaagacggcatgaagatcatcgactacgcccgccaggaggttcaggcaaaggaaatcatcctggttggccactcacaaggcggggtggtggcttcgatgctcgccgcctactaccgcgacgtgattgacaagttagttctcttggccccagctgccaccctcaaagatgacgccctgatcgggacttgccaaggaaccacctacgatcccaaccacattcccgactacgtaacggttggtggcttcaaagtcggcggcgactacttcaggaccgcccaactgctgccaatttacgaaaccgcccagcactacgccggcccggttttgatgatccacggcctggccgacacggtggtcgaccccaaggcctcacaaaagtacaacgttatgtaccaaaacggggtgatccacttcctggagggggccagccaccagttacgtggcgacggcgaccaacgggaaaccacccttcaattagtggccgatttcttaaactaacaaaaaagaaccgcgcttttggcacggttcttttttgttagtcgcggttgctcatcccaaagatttgcaagagctgtaagaataagttaatgaagtcgaggtaaagctgtaaggcccccatgacggccaagccgcccatggaaacttcggccccgtagttaacgtagatggccttcatcttctgggcatcccaagccgttaagaccacgaagatgatcacggcgatgtaggagaagatgtaggtaatcgctgctgagtgcaagaacatgttgattaaagaagcgatgatcaaggccaccaacgccgccatggcgtggctaccggccttactgaggtcgcgcttggtgaccgtcccaaagaccgccatcgtcacgaagatcacggccgacgaaacgaaggccgccgcaatgttggccgccgtgtacattgccgagatcaaggagaactcaaccccgtagatgatcgacaccaacatcaacatgataaaggaaccgaccggattcctggtggcgctaaagctaatccccatcgaaagggcgattggcaagagcaaaatgatccagaccaagccggcatgcccagcaacaaaggtgaagaccgccgctttgaagacggtcatggtcaggtaggccgtaatggccgagacgaagactgctaaagacatcaacccgtacatccgggtcaaaaaggtatttagcccgctgacgtttacttcacgccgttcgggctcacgtgaaaagttgtccacgatatgacctcccattaaattttctgttttactaactaaaagagttttactaactaaaagaatggtagcaaatgccaccattcccttcaactaatttacccccgctctttcaaacgggccttgtaatcatcctcgtacttttcgatgtcaccggcccccatgaagaccaccacggcgtcgtggtatgccaacagcttggtaatcgatgcttgatcgatgtcctcgctacccgggatcaggtcctcgaggtccttggccgaaaccgacccgttttgttcacgaatcgagccaaagatcggcgtcacaaagaccttgtcagcccggcttaaactctggccaaattccgtcaggtaagcggctagccgtgagtaggtgtggggttggaaaaccaccactagttccttttgcgggaacttttggcgggcggcgtcaatggtcgccttgatttccgacgggtggtgggcgtaatcgtcaatcaccttcatatcggcgatgtcttcttcggcaaaccgccgcttcaccccgctgaagttagccaattcggccttgatcttttccaagtcgatcttttccatgtaggccacggccaccacggccaacgaattcaagacggagtgttccccgtacaagtggatggtaaaggtccccagcttttgatctttgtagtaagcgtcataagtggagccatccggggtccggacgatgttggccgcccggaagtcatcatcgggtgccgttccgtagtagtaaacgggcacgtcaacgtttaagtcacgcaggctcttatcctcaccccaggcaaagagaacctttttgacttgccggccgtaggtttcaaaggaatccttgacgtcggccaagtccttgaagtagtccgggtggtcgaagtcaacgttggtcatgatcgcgtagtccgggtggtaagccaggaagtggtcccggtattcgtcggcttcaaagacgaagaagcgggcgtccgccaccccgacaccgaccccgtcaccgatcaagtaggaggtctgttcgacgttggataaaacgtgggctaataacccggtcgtgctggtcttaccgtgtgcaccggccaccccaatcgaggtgtggttagcgaccacttgttccaccgtttccgggtaagattggatcttgaggcccatttcctttgcccgcacaatttcttcgtggtcatcactaaaggcgttcccctggaccacgatcatgccttcctttaggttggccgggtcaaaggagagcaccgggatcccggcgtctgctagtggttgttgggtaaaggtttctttttcgatatccgagcccaaaacctcattccccaggtcctttaagagacgggccaaggcggccatcccggtccccttaattccgacaaagtagtaagtctttttttccatgattgcttcctctcgtaccgtccgctcgttaaaacagttggttacccttctcgaagtcaaaggcgtcacccggttgaccaaagtcagctggtaaaatgacgcaccccggcttatccggggcgttcttcaggttcaactcgcgcccagcacaaatcatcccgtcggattcaacgccgaccagttcccccggccaaataatctgcccggatggcatcatggcgccgaccttcgctacaatcaccttaacgtggttttcaatgttgggtgacccgcagacgatctgcaccgtttcgtcccccaggtccaccttggtgatgtgcaagtgatcggacttggggtggtcttccatttcactgacgtaaccaaccacaaacttagggctgaggtcggccaccaacggggttgcaaagccggcttcttgaatcgcctggttcaaagtggccacctggtcttcagttaggactacttgcccccggtgtccttccaaatccggcagcagttggctggcgttttggaagttgtagcccaaaagctgaccctgggcgtccttaatctcggtcacgttttgcttggtggtaaccgtttgctccccactgccgttgttgaccatcgtcaccaatacgtcgcccatgccgggacgattgtaacttgcaattagcatgtaagactcacatctccattcatttttctaaataaaccaaacctaagtgtaccatattcccccgccggcgggcagataattataaaacccgccaccactaagggcgacgggattttcattagcttataaactgcgtaagaagctttccacctgttccttggtcttgcggtccttgttgacgaagcggccaatttcttgcccatccttgtaggcaacgaaggacgggatgcccatgatgcccaggtcggcggctaaatcgatgttttcgtcccggtcgaccttaatgaattggtaatcggcaaagtcgcgttcaatttccggcatcgctggcttaataaaggcgcagtctgggcaccaaccggccgtaaaaaagagcacgtgcttaccgtccttgacgcggtcatttaacccggccaggtccgtctttggtaaagtttccattttgaaacctcctactttcacttactatttatcggtatcatagcatagcccccgccacctgccaagtaattgagccgtggggcaatcaattgcaccaccgggtcagtatggtacaatatagtcgattaatctcagatcaaggcattgccgatctagcaaaggaagcgacctgcttatggataatttaaatggttccttaaacccctggatgattccgctaaccctcgggggagcggcgttggcaggctttgtcactggcaagatgtttggtgaccgtcgccgtggggctaaaaccattctcaagctcgtcaccaacgactttaaaaaagaaggccccctggccggctcttggattgactaccaaccgattcccttccaacgctttgcttataagaccacggcttaccgcggtggcttgcggcgccaagaagacgaccaattggtcaactacgaatttttagccgacgcttacaccggttcaatcattgagttgaagaggatgaattaagaagaagtgcgactaaccttctcgacgagccgtatggctaagctagggcaaacggttggtgcgccagcaccgttctttgcccatacttagacactaggctcgtggttaggagcacgttaatagaagtgcgacccaatctcctcgacaggccgtgggaagtaccttttctgcaacataaaaaagggtagctggaaatccagctgccctttttagtttaccgggaagtgcgccttaagcttgtagatgggttgaccgaggctcgcaaaacgctgctcgtattcggtctccacgttgccctcgttttccgggctttcgtgcaagtttaaccagacgccgtcaaaaatcatcccgaagttgttaaggctggttaaggagtactcaaacagcccctggttgtcagtcttaaactccaagccgccccccggcttaaccacctgttggtagttggccaggaaggtcttgtaggtcaggcgccgtttttcgtggcgagtctttggccacggatcggagaaattcaagtacagccggtcaatgctgccgtcttcaaagtaggtgtccaagccggccccgtcgccacggaccagggtcaggtttggtaattgctcgggaagggcgtttttaagggcgatcgccgccaccgtcgattcgatttctaagccgataaagttaatttcagggtgggccttggccatcccgataatgaactggcccttccccatccccacttctacttgaagcggttggggcttggcaaaccgttcttgccaacggcccttaaagctggccgggtccatcgtcatcatttcggggtgggcttccatcaggggtacggcccactttttgtgctttacgcgcatgttagttcctcatttcgctagtgaattcgtgtttttaagtagtaacgggtcaacaagcacccttcaattagggcgacgactaggttgattcccgctcgttgccagtccaacctgacccccaaagaggcgaccgccaataaaacggccaccaccaccgctaccttggtggccaccttaacaaaggcggcctggcgctcttttggtgggaaggggtagacgtgggtgaagaccttggcttcaaagtggtcggccaggggggtcagctgggtgataatcaaatacaggccgatcaccaacagggcggtgttaagccaggctagtgggacaaagaagagtaccaccatcatcaaggccgtcaagcgggcaattaagccagataactcgacgttgcgcaccaggccccgggcgtacaagaaggtccaggcattgcccttggctaaccagttaatcaacccgttggcccaagcgcggcgcttaaccttaccttgcacttgcggtacgtcggtgaagaggttgaagaagcggtagaccgattccatccgctcccgttcaaagcggatcgccttggcccaatcggcgtcttcggtgacccggaggtgggcgaagtggccgatgctcatgacgatcgttgctacaaagccccaggttggcgatacccaccaggtaatcacttgggccactaagggttcgccaaagcccgccacgttgagcatggttaaattggccaccaaggagaggtggcgctgagccaagatcaagtgggcaaacttcaataataccattgaggcgatgatttcccccacctcaaagccggtcagtttaacggtcgccatcgccaacggcaacaccaccacggtggccaaaattgtgatggcctcaccgccaatcaggctgtagtaacgggcccgccggaagtagttgatcatcgagctggtttgcggcaataaaaagaccgggtcggccggttcaactagggtcgccaaccggccaacgtgaacgatcaagcctaaccagagggtcaaaaacagctttgcccaccactggccggggctaacgtgggcaagcatctgggcgtaggtgtatgccaacgcaccaaacaaaaagaagagggcgatgatgaagtggtcgttgaagacgagccgccagtacttcattaagagaacgaagtggcgacgccgccgttgttcaaataaatcacccatgttgctcatcccttgctaagttcaagtagacctcatccagggtctgcccgcctgccgttagttccgcgagggtcccctgggttttcaccttcccgtcggccaagaggacgaagcggtcacagtaacgctgggcggtatccaagacgtgggtcgacatcaaaataccgacgccctgctcttttttctcctggatcaggttcaacaagtcgtgcaccgcgagcgggtccaaaccgtaaaagggttcgtcgaccaccaagagcttagcttcggtcatgaaggcggccacgatcatcaccttctggcgcatccccttggaaaagtccaccggaaaccagtccaacttgttatccaggcgaaacatctttaagagccgctgcgcccgttgccaagcggcctgttcatccatttggtaggcccggatcgtcagggctaagtgctcccgcagggtcaactcgtcgtaaagaatcggtgtttcgggaatgtaggcgatctgggccttgtacccctcggcgtcgtcttttaactgcttgccaccgaccttaatcgtgccggagaacgggtgcaagaggccaatcacgtggttgatcgtggttgacttgccggccccgtttaaaccgatcaaaccgaccagttggccctcttcaactttaaaggagaccttttttaagaccgggacccgcgagtagccgccgaccaagtcatcaatttctaaaatcatggtgtccctcctcattgctgtccaatgtttgtattataccctatcttcttgttaacaagtagtggcgccctttcttcgccagtgccaccccagttcgtggtaaaataaactcatcattgtaacttggtttttaaagcgaggttttagtatgagtgattgcattttttgtaagattatcgccggggaaatccctagctacaaggtttacgaagacgacctggtctacgcctttttagacatttcccaaaacacgccgggtcacaccctcctggtgcccaaagaacacgtcgccaacctctttgactacgacgaacaactagcccaagacgtgtttacccgcctgccaaaggtggcccgcgccgttcgtgattccaacccggccatcgaggggatgaacgtcgtcaacaacaacggggccgtcgcttaccagtcggtcttccactcccacatccacttgatcccacgttacaccaaggatgacgacttctccattcacttcgttgataattccggggaatacaacgaggaaaagtacaccgccatccaacaagcgatcatcgaccacctggaggactaacatgtttgctaaccaacacgctaagctggcgacgctaaagaatcaggtgctcgccctcaaaaccagcaccgcccagctagcccaaaatacccagcgcctccaaacggaagtcgcccacctctccccggtggtgagtgacctgcaagcggaagtcagccgttttcaaaccaagatcgccccgcacgtggaaaagatccaagccgtgttaaagacggttcaagaacgtcagcagtaacctacccaataacaaagcccagccagctcgctgaatgcgaactgtgctgggcttttattgtcacccgttaatcattgattagttagatgacgatgattcgctagcgctagaagaactggagctagaactagaggttgaagaactcgaggaactggagctagaagtcgtggaagacgttgacgaagaactagtcaagtagtcgtccatgatgttctttaagtcagaatccttaatcgaaacgtcacccttctttaagaccttggaaacaacgttgtgtaagaaggtcgagttgttcaggttttgggtaacgatttggtccttcaagtcgctgatgtgagaagagtacttacccttagccgggtgcttgatcatgtaaatgacgtagtaaccgttgtcggtcttaaccggttcggtcgtgtattcaccggtcttcaaagcaaaggcggccttacggtaagcagatggcaagctagtatccgtattatcaaaggcggataagaccccaccgttagacttggtcgtcgtgtcggtggacttggacttagccagcttcttgaattccttaagcttgcttcccgacgtgttgtttaaggtgtcgatgatgctttgggccgtttcctttgaacccaccagaatttcggcggtctgaacctttggctcgtacttcttccattgcttctttaaagcgctggaggagaaggtggagtaattgcgcacggcggcctttaagagcaggttagaacgaatctgttgcttaaaggacttggcggtcaagccttcctcagataaaacggttgaaaatgaggagccgtactcctttttgtaggcgttgtattcggagttcacctcggaagtcgaaaccttgcttccgtactgcttttccaacaccttgtctaggatcatttgctgaagcacttgtttcccattggaggtttgcttcatgctggagtagtattcgctctccgtgatctttccaccactggtggtggcgaccgccttattaccgcaggcggccaacggcaatgctagggctaacccagcgatgattgccaacattttctttgatttcaaactatctcacatcctttggattttttcaccaatctaatataacacactcaaaaagcacgtgcttgctccttagaaagcttttaggctttcttcacgctttcttcgtgtcttgtccggttgggagccggtagaactgccggcggccaagggcaaactggcggggcgaaaattcacccggggcggtttgctctaacgccccgttaatttcggtgatcgccgcatcgagctcatctaggcggtgtaagacctccgcttccattagctccggttcaacgggggacccgtactcacgcaggccgtggtgggccaagatgacgtggcgaagcaagaccacctgggggttggtcggcaataaaccgacctcttggcaacaggcgacaatttcgccatcaacgatagaaatgtggcccaacaagttcccggtcgtggtgtactgggtcgctaccgggccggacaactcgattaccttacccatgtcgtgcaaaagggcgccggcgtacaggagttcccggttgatccccgggtactggtcgcaaacgtttttagccaggcgcaaaatcgacagggtgtgaaaggccaacccaccgaccagggcgtggtggttgaccttggccgccgggaagttaaagaagggcgctccgtattttttaaacaaatgattaacgatcgtcgcccattcgacctggtgaatggccgctaaaaagggccgcaggtcatcttttagttccccgtccgtttccgccacccggggcacaaagtcttccggttggccctcctctgggctagccaggcgcagctcctggatccgaaactgcaactggtcctggtaggtttcgacctggccggcgagctccaccaccaccccggccttaaattgggcgacctggttttcggttgcgtcccaaaggttaccgctgatttcaccggtccggtcggcaaagagcagggctaaaaaggggttcccggtccgggtcgtctttaactgggcgtccttaatcagtgccaccccttcggtcgccaccccgctagttaagttaccaatctccatcgtgatccctccttgttaaaagaggctgggaaaatcaaagtttccccagcctcttttcaaatcttgaatgttacacagctaacgtgctcccaaccacaaacctagtgcctaagtacggtttgtcgagagggttggtcacacttccccgtaactagccctcttgcgggccgaattgcttgtaaagttcttgtagcgggccagtgatgatctggtttaattgttggatcatttggtcaacttgttgttccttggccatcaaggcttggatgacgtccttgctagtaacgtctttggccagggcttggatttccttgatttcatcttcggaaatttcttggccctgcatttgcttttgttgggccgccgcttgcttagcttggaacttaacgaacaggtccgttgcttccttgtcggcctttaagtcatcaaaggcttcctttaagccgatgaattcctgcgtttgccgcatttggcgttccagttcgtttgccgtatcgtaaatgtttacaaccatttgaatgtgtcctcctaattgacattgctttcattgtatcatgaccggcctggtctagctagaagagcgagcggatgttgctccaggcgttttggacctgttggttaacgttattggcaaagtcggaaacccggttccacaggttggagccagacgagttcgatgatgatgcggacttggccgcctcttgcgccttggtttgggcgtcttggacggtgaacttagtcccggcggtgttagacaagatcccactcatttcggtcttaaagaggccgtagatgtcgttattttcgacgtcgtaaagctggttagtcttagtggtagtgtcataaccttcccaggtcaccaccaccacgtcgggggtgtagccgatgatccacttatcgcggtcgttgtcatcattcgtcaaaccggaattggtcgtcccggtctttccggcgatcgtgtaaccactcggggcggcgttcttcccggtcccgtgcttgaagactccgatcatcatcgaggtcatcgtgttggccaccttcttagagatgatccgcttggtcgtcaacttgttcttgcgcttaacgaccttgcccgaggcgtccacgatcttggtgatgtagtgggtcgtcggcagctccccacccgaggcaaagacggcgtaggcccgggccatttgttgtggcgaaaccccgtcggttaagcccccgagcgccagcgccaggtttttatcgctcttcactaccggtaagccaaacttttgggccatcttgtagccggtgtcgaccccgatcttgtttaagagccagaccgccggagcgttgagactttcgtacagggccttatacatcggtaccgatcccgagtaggtgttgtcgtagtttttcggggtgtacttgttagtcccgtaggattggagcttgtcttgcagggtcgaatcgtagaagtagccgtgcaaaagggccggggtgtagacggcaatcggcttgatcgtcgaccccggttggcgccgcatttgagtggcccggttgtagccccggaagacgtgggtcccacgcccgccgaccacggccgtcacgcccccggtcttagggttaacggcaatcgaagctgactgaacgatcgtcccgtcagccttggtggacgggaagttgttgtcattatcgtaggtatcttgcatcgcttcttgctgcccctgatcgagggtggtgtaaatcttgtagccgttattcataacctctttttcggtcaggccgtaatccttgatcgcctccgaaattacggcgtcaaagtagtacgggtacttgtaggtgttggaattactgtacccatcttcaacggttaacggcaccttcttgtaggcattggcctgtgcctgggtcagcttattattttccaccatcaggtccaagacgaggttgcgccgttccttggctaatttcgggtggtcaaccgggtcgtaaatccccggcgacgtcagcatccccgccaaggtcgcggcttgtggcaccgtcaactggctagcgttaacgttaaagtaacgcttagcggcgtcttgcactccccaaaccccgtgaccgaagtaggcgttattcaagtacatggtcaagatatcttttttggagtactgattttccacttcgatcgagatgaagatttcctcggccttacgcgagaaggtttgctgctgggttaaaaaggcgttcttgaccagttgctgggtcaaagttgatcccccaccggaaatgtagtcccggcccaagaccttatttttgaccagtaggtaggccgcccgggccagtcccttaaccgagaaaccgtgttcgtggtagaagttgcggtcctccgtcgataaaacggcgttggaaacgttactcgaaatcttatttaaggaaacgtaggtccccttttgtgaatacaggctcccggcgctcttaccgttatggtcgtaaaccagggttggctgctccaagcgggcctttaagtccttaacgttagacgttttagccacaaaggtcaggtaggcgctcatcaccaaaaagaggctcaagacaattatgatcaaccagcgggtcagctggaaacggtgccactggtggcgaactagttgccaaacccggtgaccgacttgcttgaccccttctttcaaccgctccttaaatggtaagcgtggcggtctttgacgttccatcatttatcctccgaacgaaaacatgatgggactattttaacattgcaagcaagccggcgccaaacctagccccgatcttaaccatttgtcaaggaggaagtgcgacccaatctatcaaacaggccgtgggctaagctagaggaagattggtgaggtacgcaccgttcttcgcccgtacttaggcactagacctgtggtcattttccacgttatcggaagtgcaacccaatctcctcgacaaaccgtatgtaagctcgaataccgaataaggtacacgacaaatgtttagatttgcgcaatacagtgagtgcgacccaacctatcaagcaggccgtctagcggtcattgtgccaaattttagatttgtcctgtcaccaaaacgggagtgacgcccgaatggtttggcagatatccctcagcaatgaagttggcaaccttttccccgtatcaaaaaagccccaccgcagagcgcgacggggcaacgtattaaactaaattacatttcgtctggtgccttaacgccgaggagggctaaggcggacttgaggacgtcggaaacggcttggacgagggctaagcgggagagcttttggtcgtcttcttccagaatccgggtgtgggcgtagtattggttgaaggacttagccaaggacagggcgtacttcccaatcaaggacgggtcgtattcgttagcggcccggacgatcgtttcttggtattgaccaatcttcttggctacttcccaggcttcttgaccatcgacggtcaacgtagcgccttcaaaggatgggcggccggccttacggaggatcgattcggcccgggcgtgggcgtattgaacgtatggaccggtttccccttcgaacttaaccacttcttctaacttaaagtccaccgagttggtccgttcgttcttcaggtcgtggaagatcacggcgccaacccccacttcttcggccacttggtcggcgttggccagggtcgggttcttttcttcgatttgttggcgggccaacttgatcgagtcgtttaagacgtcttccaattggataatgttccccttccgggtagacatcttcttcccgtttaagctcatcaaaccaaacggaatgtggtgaatttggtctgaccaggtgaagcccatttcggacaggaccgcctttaattgggcaaagtggttgctttgttcggcccccaccacgtacagggattgggcgtggtggtacatccgcttacggaataaagcggccgccaagtcccgggtcaggtacagggtggagccgtcgctcttgcggatcatggccgggtttaagtcgtacttttccaggtcgatgatttcggccccacgggattccttaagtaactgcttgtcttctaagagggttaccacttcatccatcttatcgttgtagaaggcttccccgttaaaggagtcgaaatcaatgtccaagaggttgtagatcttcataaaccgttgcaaggacacttcccggaaccacttccagagccgctgggcttccggatcgccctgttcgagcttagcaaaccattcccggcccaggtcatcgtattcggggtgttcatcggcttcggtgttgatcttaacgtagtacttttgcagggtgttgatcgggtccttttgcacctctgcttcgtccccccacatttcgtaggcggccatcaacttcccaaactgggtcccccagtcaccaaggtggttgatccgtaccggtacgtagttgaccttagccaagatgttggcaatggcgttcccgatcacggttgaacgcaggtgccccatccccattggcttggcgatgtttggcgaggacaggtcaatggtcacgtgcccctggtgacccaggtcggtgctcccgtagttagctgggtccgccaagacggcggccaagatttctcccccgacgctagccttgtccaagaagaagttaatgtacgggccggcaacaatcaccttttcaaagccactttggtcgatttgttcagccagttcgctagcaatcatttgcggcgccttgtggagctccttggctaaaaagaaggttggaaaggcgtaatcaccgttcttagcatcctttgggcgttccaactttgcttcaagatcttccacactgaggtttggcagcaccttttgcagtgcagacgcaacttgttgacgttcgttcatcctaaattcctcctaaaaagtaaaaaagcccccaataagcccatgcttactagagacgagatttcccgcggtaccactctaattgaatgtatcattccactcaaacttcgatttaactgctggtccctgacacgccttcgtaacggcaacgcccctcctttcaccaacgaggggtcgctaattacgttcgccgttactactactccagggaccggaatgcctttattataccaagctccggcagaataacaagcaaaaaaaatcaccgccgaagcgatgatgagaagcgggtaacgagaatcgaactcgcgacgcaaccttgggaaggttgagttttaccactgaactatacccgcataatttaatgagtaattaacttactcatttataataccacattaaattgatttgtcactacttatttggaacttttttcgtttttttcggaactagccgactctttagtcgtctttgtccgccgccggcgggtgctcttacccgatttagcagcctttgccgccgcttcttcttcttccttagcggccgcttctaagtcctctttggtccgtggcacttcctttaagatcttggcttcgcccttccgaaccacggcccggccgtttaattcgttgatcccactttgatctgccggatcgtattcggtaatggcaatcattactgagttatcgtaaaccttttcgacttccccggagaaatcgtgttctaagggaccaaacttcttggccgctactttatcaccaatcttgtaatgggtcatgccttccacctcactgatcaacttttttcgcaataaaggctattttacacattttaagatttttttcaagtcccacgccccgttcgccggtcaaatgcggcaatgctacaatggtggtaaaccgatttcaaggggaattatcatggatccactttactttgccgttaaccttctggggtttctcggcctcatctttaccatttaccggggcctgcgctcccaccaagaaaaacgggtcacgacctggttggtcatcacccgtttaatcatcctgttattagtcggcctaacgatcgtcgaccagctccactccctgccggcgtttaatcctttatcgatcatccggggcgtgtaccttatttttttgtttgtggttagcgaagtcaccttcggccgcaagcaggaaagctttggcagtccccaccaaatgatgcgcttggaattgttaacgctggctggcatcctagtcttgccttggtaattacagttgccagtaaccactggtaatcgtgtcgagcatctttactaactgcttggtctccttgacgtcgtggacccgtagcacccgcccgccgtgcaggtacatgtaactttcggcaattagggtcacgtctaggcgatcgtctttggccagaccaaagagttgcttaccaaagcccttgcgcgagatcgccacgatcatcggccgcttcaaatagttgaactggtcgaggttgcgcatcatggcgtagtcttgttccccgtcggcaaccttggagtagccaatcccctgatccaaaagaacccgctcccggtcgataccggccttttctagcatcgccaggttctcctcgaagaagtgcttcatcgccaccgtcaggttttcgtattcgtgttcccggctcgagtgcatcgtcactaggccaacctggctatcttttagcagggttaacttctgatcgtcatccaaaaaggcgttgacgtcgttaatgatgtccacccctagttccacagccgcttgcatgaccgggtacttgtaggtatccacggcaattgccaccgccgggtagttagcctttaagtactcgatggccggggtgatccgcttgatttcttcgtcgggacttacttccacaaagccaccgggcttggtcgtttggccaccaacctcaatgatgtcggcgccatccttgaccatctgatcgatgtgggccttgacgtcgtcggttgcttggtagcgtccgccgtcataaaaggagtccggtgtcacgtttaagatcccgtaaaccaaggggtgggcggtgacgttaaaggtgaaccgaccggcccgccataagatcgccgtttccttagtgagcgcctctaaggagctttggagttcgtcatcggctggccaggcttgcttagcccacttgaccaacactggtaaggcggcctgcttgaccatcagggcgatcccgcctgcttggctagcaaacgggacgtctaaatgttcgatcaattcaataacggcgccctgctgtgcttggtcgacttgccaaaacaaaaagcgctgttcttccaccgtagccagttgcgctagcaccgcctggttaaaggcgtccgtggtggttggcatcttaattgaaatcttcaattctcttctcctttagttgttccatcaggtcccgcgccgcccgggaacggtgcgcctcttttaaccactccgccgttggcaatagcgccagcggctttgtttgtcccgccggaattaataagcggtcaaagccccggtcatcgtcgccctggggagtggccgctaaggtgccggttaagcaaccgtggcccaccgccacttcctggccgtcacgaaagaggctgacccaggtttccatcgtaaattcccggtcacgaccggccaccatcgcgaggacggtttgtagccggtcgccgccgtgttcgtccagttcgcgagcggtccggatccccaattgacccgggcaagctgctaaagtcagtcccgagtcgtcggctaagacgtactcacccggcatggcttggctaacgaagcgggccttttgccgggcgttgtctaggtaggacgcgaccccctcggcaggcattggctgagctagcttgggcgctggggcggcgtcaatacccctgctggaaaggatcatggccagctcggcaaccttgccctggttgtggctagcgatccaaactttcatcgttgagcccctcttctaattccttgattaggtaaaacgagccggtgacgataattaccccgttggtcggcgttagttcacgagccaattccagggcttcgcgggcgtcgggcgcccattcgtgacccattgccgttgctagcggccaactgtccatcgcccgcccgtggttatccggggtggtaaagatcaggtggtcggcaacctgctggtacatggtcaccatccgttcaacgtccttgtcggccaaaaagcccagcaccatcgttaccgggcggtcagcaaagtcctcttggatggtcgccaccatttgcttagccgcatccgggttgtgggcgccgtctaggatcacgagcgggtcgtggtcaattgcttccatccgccccgggaaggtgacccgttgcaagaccttctccagcatggtctggtcaatggtgaccccgccttgccgtaactgttccactatggccagcgccgtcgttaggttctccgtttggtagtggccatgaaggttgcacgggcaggtgaactgttcttcccccatctttaccttggcggtcccgtccgcaagtttgacctggacccggctggccgcttccactagcggtacgtcggcttcctgagcgcgttgggccaggatctccttggccgcttctggctggttaggcgccaccactagggcgcgggtttggtacttaatgatgccggccttggccttggcgatgtcttcaatcttggaccccaaaatttgggtgtgatccagggccaggtgggtgattaccgccagggcgggggcatcaattacgttggtggcgtcgtcttggccgcccagcccgcactcgatcactgcccagtcaaccgcttggtcggcaaagtattggagcatcacgaccgtccaccattcaaagatggtcaggtcctgttcggtcatgtagtcaggtagggcgcagagaatctttttaaaggtcgtcgcaaagtcgtccttgctaatcaggttcccgttgaccaggacctgttcgcggtcgctaatcattgccggcgagttgaagtggcccaccttgtagccgctggtgatcaaaaaccgggccactaaggacccggtcgagcccttaccgttggtgccggcgacgtgaataatttggtattggtgctccgggtggcccagggcgtctaatacctggtgcaaaatttctaaacggttgtcttcgccggccagcatttgcttgggtagccggtcaataatctcttggtattcactcatggtcgtcccctcacttggtctaggaattcttgtttcaggttgggttggtcaaaaaaggcgccggtaaagtgactggtgtaggtaaactggccggccttggtcaccccccgcatttccatgcacatgtggcgggcggccaccaccaccgccaccccggcgggatctagcaggcgggtcagctcctggactagttcggtggtgacccgctcttgcatccccggcttgtggctgacaaagtcaactaagcgcgggatcttggacaggccaatcacgcggccgtttttcggtacgtaggcaacgctgaccgtgccgaagaagggcaagaggtggtgttcacacatcgaatagaagggaatctcttggatcgccaccatttccggggtgtctgccacgtgaaaaaccttgtagttggtgacggcttccgggcgcttagcatccagggaggaaaagatttccgcgtacatcttcgccacccgctccggggtctcccgtaggccttcgcggtcggggtcttcaccaaaggcctcaatcatcatcttggtggccttgattaatttttcttgatccattctgctacttcctctttcttaattcgttgggtaagccactcccggtccggggtgtccctgattagttgggctaggtgccaatattcctgttccttgccaggcatgatttcttgcaggggcaccaggacaaagcgccggttggccatttccaggtggggaatcttcagggtggggctggttaaccgtgtgcacccatacaaaacgatgtctaagtcgatcgtccgcgggccccagtggattaaacgccgccggtgaaggctttgttcaatgacgtgtagccaggctaacaggtcccaggcgcttaagttagtggacaggcccacggcaatgttgaggaagtttgcttggaccaccccaccgaccggggccgtctcgtaaaccgacgaaatgctggttacctcgatctccgggcgccgctctaacaaccgcaccgcttgctttaagttagccaggcggtcccccatgttagtaccaatgctcaagtaggccttagtccacatcggacgccctccccgtcacctcaatttcaatgttatcaaagacgccggcaattggcaccgcatacttgcgaattcgcaccgtaattgtccctagggctgggtactgggtctgtaaagtctttaataacccattagcggtgctttcgatcaggttaaactggtggccttccaaaaactccttggtcgtgtcgtaaacgtcggcgtaagaaaccgtttcggtcaattcgtcatgttgcaccgccgtttcaatcgggtaagacatatcgaggtcaacctctaggcgttgccccatccgcttttcttcggcaaagaccccgttataagtgtgaaaaaccatgttattaattcgaatttgccccattcaatcaccttttctctttattttgttcgttttcttcgtgcttatccatcataccgcattttctaatcaacgagaactcccgggaagaaattaaggtaggtggtcaataacctccgaggtaggcctgcggttatcgactacgttttctgtctaacatttgggaatacagtaagaggctaggaaaaacgcttttcccagccccttctaaattgtatttatcgtgcgttgagcaagaccgccatcgccacgatgttattgagcatgtggagggcgatgacgttgcttaggtgaccggtcttgcggtaaacaaaggcaaagacggcccccataaagaagtaaatcaaatacgaaaccggcgtcgtgctggcgtgctccagggtaaaaacaaccccggataacaaaattggcggccaaaccgcatcgtctttgaaaaacaggttcattaagacgccccgaaagatcagctcctcggccaccggcgacagtaaaatcccggagccggccaccaacatcatcattaaagacgagcttcccatcaggttggcgatcgtttggttattggtcgtctggctctggtggtagatagcctggtttaaaatcgccaacacgtcttcgccggcaatcatcaccaggtagcccccgattaaccaaccgagccggctacccaccccctggggccttggtgtccaccgacggtacttgtaaaacaggtgggtcgcccaaacgataatggcgacaaagaccactaagtcaacgaccagccacctggttgccaccgaggaatgactgtacatattctgcttaaccagtagttcaaaaattggtggaatctgaatcgaaatcgccagtaacaccatgatcaggacccgcttgggcagggccaaccttgtttcgtccatcgttgacgccccccttttttacttaacggctgccgttgacgaccgcaccactagttcgacgggtaagctaatttgctgggttggcgcctgcgggttactaattcggctgagcaaaagggcgctggccttttcccccagttcctcaattggctgggccaccgtcgtcagttgcggggtgacgtagcggtctaagtcaatcccgtcaaagccgaccaccgatatgtcatcggggaccttgaccccccgctcggccagtccccggtacaggccaatcgccatttcatcgttcgcggcaaagaccgccgtcggcttggtcgctaaaacggcgtcggtggcctcgtagcccccctgcttggtgagggtgccataaactacctggctagccgggtcaaagtcgattccctcttcggcaagcccgcggacaaagccgtgctggcgctcctcaatatttttaacgttcttagggaagagcagcgtgatcttttggtgcccttccttagccaagtgcttggcaactaggtagcccccctggtcgttatcgacttcaatccggtcgccgtccggggtgtcgttttggtcaaagagtaggtagggtacctggaggggctttaaaatctcgtcgatcgtctgggtcgttaccgaagccgaggcgatgatcaggccgtcaacggagcgctccaccagccgctgtaggtagtagcgttcctggtcttcttcgtggtcggccgaaaagatcagcggcataaagcccgcctggcgcgttgccttttggattcccttgacaaaggcggcgaagaaggggttggcaatgtttggtaacaagaccccgatcgtcttcgatgagcgcatgattaggttgcgggcgttaaagtccgggacgtagttcagctgttttttaagggtgagcactttttccctggtttgttcgctaaagcgctggcccttcccgtttaggatctgggagaccgtggtgaccgaaacccccgcttgcttggcgaggtcgcggatggtgattttatttgccatgactgttccttcttgttgttgatcttaataaaacagtttactaaatttttagtgttctgaccattcctcttgcttattcctggtggaaaacctgatccaaaaccttgcgggcggtggcggtttgcgtcccgcgcacccttacgtagtcgatctgggccagcaagatttcgtactcccataaagaagataagtcgtgggagttgaagtagtggagggttagcttaatcgtccccaggtcgctaatcaccccggtaaaatcgtcgccccccttgtactttttggttccaatcaccagcggcaagtcattttgataggagtcagttagcagggtgcgcaagatgttttttccctggtaatcgtgatcgtgcaagaagtcttgtaggtgccacaggtcaaagtaaccattttcctgggcgaccttgcacttgagcgaaacggtcgttaagtaatcagtttggctccggacccggtgaatggaggccagccggaccgccgttaaaccgttgatcttaccgtcccaatcgatcccgagtaagaggacaaacaattcgtcgacggccaacacaaagccgacgtcaaaggtctcgccagcctcgtcaaaatcgtggacctccaccaaactcccctgttgtttgctgacggctagttgcgcccggatttgttcttgtgtcattagttccattttcttgttcccttctgggcaaaggggctgcccgttaatttcattatcctcaattatttaatgatgggcaagcccgagcttttgtagtaaaattgtttcgttgcgaaaaaattttaaaggggagtcatcatggtgattatcacagcaggaatgatcggggttggcaagaccaccctcaccgccaaaattgccgaacacttaaacacgaaggccttttttgaacccgtgggggaaaatcccgtcctccccctctactacaaggatcctaagcagtacggtttcttgttgcaaatctactttttaaacaagcgcttttccatgatcaagcaggccctgtccgacgacaacaacgtcttggaccgctcaatttacgaagacgccctcttcacccgggaaaacaacgccgagggaaacatcaccgataccgaactgggggtttacctctccttgctcgataacatgatgaacgacctcgaacggctgcccaagaaggcgccggacctgatggtttattcggaaaccaactttgacacgatcctctaccggatcaaaaaacggggccgcgattacgaacaaatcgacgccaaccccgagttaaaggattactactacaagatgtggtcggcctacaagcaatggtaccaagattacgatgcctcgccgaagatgaagatcgaccttgataagtacaacttagaggacgaacaaaacgtggccaccgttctggcaatgattgatgaccgcttaaaagaaattcgataaattagaagtgcggaccaaccattggcagggcacggcaccttcctaacattcaaagcttaaacaaaagtcgttgagcgatctttttcgcccaacgactttttatttggtcactaatttccgcaaccaggcgagcaaccccaccgaaccggcaccaccggccactggcaccggccacgggaccccgccagcctttaccggactggcggcctccttggtgttggccggtgaagctgcaactgaactggtggcggcggagcttaggggcgccgtcgtgacttcagctgcttgtgcttggctggttgacgttggcgacgccccctgttggtcatactggtcaagttggtaagcctcaatcagttggttgagcttggcctggtaattagggtcggtcgcgtaggtcccggttaaagcagccgtcacctggcggtagctgttagtagttgaccggtggacaccccggtaaagcccctggtttagcaccttagcgtagtcggcaaagctagcgctgacgtcggcgtagctcttaaagccggccgtaatcgtcacgtcttgaccgcccaggttttccgtggtcggcattaccaccccggttcccttgataccaaagaggttatggtgtaaccggctcaggtcactgttgccccagttagattccaaggccgcttgggcaatcatcaccgacgggtagagatcgtattcctgaccgattttgacggcggccggtgccacctggttaatgaattgacgctggctgattgtcaggggcaagggagcgtagcgttcgtggtaatcggccgccggggtgaccgttgcctcggcttggctagccactgcgctcccgtcgctgagcgattccgccagtgctgcctgttcatccccgctatcacttggtgcgctggtcgcttccgttggttccgtacttgacgctgcgctcgttacttgtgacgtagagattgaactagcggccggcgcctcactaaccgggtggtcggcaagccactgctggcctctcgttaatccctcctggtaaccggctaattccactggatcggttggctggtggtgctcaccggtcagtaaatcctccccggccaacttgactcccgctaggtaacgggcctgttcttcttgtgtccacccttgattagtcgccgccttagccgtcattggcaacgctagggctgtgatcagggtggtgactgtcatcaacttcttcatcaaaatccctccttcacccttaaatacgcaagaattggggaggttaacgaaaaacgcccggccatttttgccgagcgttttttcattaaactagtaaattaccaccggttcgtcaaccgacaagtcattgaaggcgtttggggcgtcataagtgtgcatgttgacacacccgttggacccgttgttgacgtaggcggttgtcgaccagttggtccgccaggaagcatcgtggaaaccacagccggattcggtaaacggtgcccagtaagaaactggcgaggcgtaagccttcccggtatcgccaatcccgcgtagggtcgtattgcgctgcttgtacatgatgtagtaaaccccggttggcgtatcatcgccactggattgcttaccagttaccacccttgcactgtagaccagcttaccatccttgtagaaccaggccgtttggtctgagatcgaaacttcggcgtaggtatcaccgatgccgttgttactggtggtcccgtagccgaccccaccggtgttgtagccgattccgtaaacgtcggccttcgcactaacgctggtcgcccccttcagcagggcgtccgtcaaggtcttggtggccttagtcgtgctaatccgccaaccgtaggacccttgggcactggttgtaattgtgttgccggcgtgggtcttaaacttaaaggacttgccgagcgtcgactgggccttgttgatcttggcaatctcctgatcaagggcggcggtatcaaactggtactgcccgttttgataggttgccttggtgatgatatcgtcactagtcagggtgtaggacttgttttcaaccttataggtgatcttcttgttgctgagcttctttaaggccgctacttcctttttgaccgcggcgctgtttttagtcaatggcgtcttcacctttgcggtcagctggatcgaatcggcggccaattggttactcaattcggcttgaatcttggacgtatcgtaagcggtccctttcttggggctggtgaccgttaccttgttatccttccaaaccgccttggcgtccacggccatcacccggttttggtttaacttatcaaccgccaccttaattgccttcttcatggccgaaagttggctggtatccaactccgacggggtcaacttgtagttagtctttttcgctgacggcaagatggtggcctgttcctttaggaccttggttaccttggccttgtcggcgctggtgtagccagacgaggtgctggttccctcgtagatttttttaccgttcaggtaaacgtcgttgctacgtttttgggaggcgagcttttggtaagctgcttcacttgtcaggccaccgaccttcaccccgttgatggtcacgttcttgttaaagtgggagtggtggtagtagccgctagcgcccaagccaccaatcactgccacggcggccagcgccccccaaattaatttctgggtcttttccatgtaggtcctcattcttatcaagcgatctgttagtaaggttaattataacaggttaactatgaaaattgagagaaaaaagaccgcaccgcccttaaagtttgagggagggtacggtctttagcgcttacagttccggataagaggcccgcttaacgctaatcggcttattttcactgtcggtcttgaccaccgtgacgtcgcacggggcctggcgtaccacgtaggccgccgtcgagccgacaatcatccgcccgatcacgttgagcccagaagccccgatcacgatcaggtcgatgtggttgtcctttgggtaggactcggtcagttccaccttggcgttaccgatcatcacgtccgtgtgcacatccgttacgcccgccgcaaccgcttcttctttcatcttggttaaaacgtccgtcatcttcttggtggcgtcgtcgtaaaggccgcggtccacgaagccgtagcctaaggttgaaccgctcgggtactgttccccgttaattacgctcaccaggtgcaaggtggcgccgttttcctttgccacgtgcaaccccttttcaaaagccacttgggattgctttgaaccatcaaccccgaccattacatttttgtattctaccatatagaatcacctccaagtgattacatcatccgcccttgtttttattttaccacggtaaaccgtacaatgaaaccgttccctaatcagtgaccaggtcgtgaatggcttccatgtagattgccattgacatgatcaggtcgttgaccggttggaattcgttggcctggtgcatggtgttggtcgtggtcggcatcaaagcaccaaaggcaaccccgcgcttcatcaggcggccgtacgtcccgccgccgaccacttctggctgggccccctgatctccggtctggtgaatgtaggccttcatcagggtttgcaccagcgggtcggccgggtcaacgtagtggggaacttccccgtcttggtaggtaacggtgaagtgtagcggttcggccaccttcgccaccgccgctttgatttcatccggggtaatccccttagggtagcggaagttcatgtcaatgtgggcgccggtttgttgatcaaaactcaagagccccgcgttcatcgtcatttcccccatcaccgggtcgctaaaggcggcgttaaacttatccatccgggtgtctaagtgtaagtagtcggccacgtaagcgacaaagtccttggcaaacccgccgagctggagctgctttaagaaggtggccaggtaagtggcggcgttaatccccttttccggttccattccgtgggcggccttaccgatcacttcaatgtgggcgccgtcgggttcaacctcgatggatccggtaaccgggttttcgtctaaaaaggccgtgaagcgggtgaccaggtcctcgttgtcggcgacttccacgaccgccgttgcttcccggggtaccatgttgaagcgcagcccggcgtcaaaggacttcagcaggtcgccatcgccgttgcctcccggcaggtccaagagcattgaaacctggcccttttccccgttgatcaccgggaactcggcgtccggtgagaaaccaaaggtcggcgccggttcaacctcgaagtaacggtgcatcccggtccaatcagcctcttcgtcggtcccgacgatgaaacgaaccttcttgttgaagtgaaccccctggtcctttaaggtcttcaaggcgtagtaggcggccatccccggccccttatcgtcagaagccccgcggccaatcaggttaccgtctttgatcaccgggtcaaagggatcggtgtcccaaccgttgccggccggcattacatccaagtgggctaagatggccagggtttcatcaccctccccccactcggcgtagcccaccaggttatcgatgtttctggtccggaaaccgtcttgatcggccatttccaaaaaggcggccagggcttgggccgggccgggtcccagtgggtagtcggcggtcgcctgttcgtcatccctgacgctttcgattttcatcaaggagatcaggtcggttaggtaatcttccctttgtgcgttagcttcttttaaccaatcggtcattttttaccctccatcatgttcactttgttacagataatgataccataaagctaacggggactaaaatggtcctcctgaattcgttttcagccgagggggaatttaaatgaaggatttaactgaacagatactacaagatgtgatcaccacccggccccaggaaagctttaagggcacctttggcaaggtcctcttggtcggaggcaaccaccagtttggcggggcgatcatcatggccgccgcggccgccgtcaacgccggggccggcctggtaacggtcgcctgcgacctggtcaaccggaccgccttgcacgcccggcttcccgaagcgatggtgattgatttttccaaccaagccgccctgcttgaaatgcttaacggcgtcgatacgattgtcgttggcccgggcttgggggaagaggagcaaagtcttgcggtgttaaagaccgtttttgcaaataccaagcccacccaaaccgtggtgattgacggatcggccattaccctaatggccacccaccaactagcggcgccggccggtcacctagtcttcaccccccaccaaatggaatggcaacgcctctccggtatcccaatcaaggaccaagcagaagcccttaaccaagcggtccaagaaaaactggggggaaccgtcgttttaaagcgccaccacactgaaatctacactgccaacggcaccttccgcttgccaatcggttcggcggcccaagcggttggcgggatgggcgacaccctggccgggatggttggtggcttttgcgcccagtttaaggaggctggcgaccaggccatcttagccgccgtttacgcccactccgccatcgccgatcagattgccaaagaccaatacattgttttacccacccaaattgcaacggctttgccctccttcatgaaaaaggttgaacaaggcccggctacccaccacattggttttttagggggggaattaagatgttaaaagaagttcacttgactagcccgctgcctaccgcacaacaagccattgaggaccgcctcaaccaacggggctttaaaatctttgccgccatcgaccaggctgcagaagcccaaaacgtcggcctaacactgaaacccaccgtcctcttgatttttggtaaccccaaggttggtaccctgttgatgcaagaagacgaccaggtcgcctttgagttaccaattaaactgttactggtggcagaaggcgaccacaccaaggccctctaccgtgacccgcacgattttcccaacgccactaagctaagcgaggccggtcaacaaatcatcgccaacatggctaacctttaccagtccgttttagccgacctatagaaaaactcccgccgctcgggtttcgagctgggcgggagttttctttatttaatatggaaacgagttcgcaggccggcgaagcgatcaccgagtagggtatcaaccaagcggtacttaagggccaggtaggcaaagaccccaccgccgatgaccaccccgattaccagggtgaaaaaggcggtgaagcgcccgtacggactaaccaccagccccaacaagagcatcaccactttgaccacggcaaacatgatcaaggaaaaggcgaggatctggttggttggctgggccatctcgttgaagtgcaaggtgaactcccggttaaaggagtgcaggatgcagtagttgataaacagcatcgccaccgccgttgccagcaggggccccagccccttaaagagccagatggcgggaacttgcacgataaacttaatgatgatccccacgaacaagaagcgcatcatcttcttgttttcggagatcccctgcatcatggccgccccaaccgtgtacatcccgtacggaatcgacatgaaggcggcaaactgcaacaccgtgatgccggccgcgtcgtagcggtaaaagaccgtgtaaatctgttgggccaccgccgctaaccctagggccgccggtaccatgatgaagtaaaagagcagcagggcgttttcaatttggcgccgcatgtcttgaatgtcatttttagcccgggcctcggccaacagcgggatcgccgtggcggccatggcagaagctaaggagatgataatcatgtacagcttgttggcgttaaaggagaacagggcgtaaaccgtgttgagttggtaggcgctgtagttgccaaaccacttcatgatgtcaaagaaggtgtactggtcaatcaattgaaacagggtgatcccggattcaatcacgataaagggaattgactggtaaataatttcaccaattaaacgccgggtcgacacccccgtcgccacttcaccctggctcaccagggcgtccatctcgcgcttgcgccgtaaaaaggcgtaggctaacaagacaattgaccccaacgccccgatgaaggcggcaaaggtcgattgggtaacggctttgacccagttaccactacccatctccatgatcacgaaggtggccagcagcatgtagatgacccgcaacagttgttccacaaactgcgacatggcggaaggggccatccagttgtacccctgcaaaaagccccgggtgatgctcatgccggggatcacgaggaccgcccaggctagcgactgaatgaccggaattacatccgggtcgcccccatcaagcagggaggccccgaaaaacatcaggatcgagcagaccagccccatcgccaccgagacgtacatccccgagtgatacaagcggcgggagaccccgtactggttaatcccgttgtagtgggccaccatcttggaaatcgccgaggggatcccggccgttgcgaccatcaaaaagaggctgtagatgttatatcccttagcaaagagggcgttggcctggttggaataggcccccatccaagtcacccacgggatgatgtagatggcacccaaaatccgggagaggatcgagcccgccgtcatccatgcagaaccggagatcattttgcgccgcgaatcgtcaagggaggcggaagaagcccccggttgattacgtgaatccatatctttctttcctcgatttttaaaaaattacaatcccccttattttagccttatttaatgggggtcgcaaacccttttaactaccgctcccctttgtcccccacttagcttatcaatacttatctaaatcggtggtgataagttccacgtgaaagtcccggtactgctcacttatttcccgttggtcgctcggcgcggggaccggttcgcggtggctttgtaggtcgctaatgattatcgctagaccaatggttgcccgcaggcgggcccggtcaaggtcttcgtccaccacgtcggcatccggtaggtccggaaagtggatggtatagccctgcgatgtttttttaatgacggctggataggttgttagttccattttaatcaccaaatgaagaaaaggttggaaaaactacgagttttcccagcctcttaccgtgtgttcgaatgttagacagataacgtgctccccaaccacgggcctagtgcctaagtacggtcaaggaacgatgctttccgcatcaacccttgccctagcttagtcaaacggcccgtcgaggaggttgggtcacactcccaaagataacgtgctccccaatcacaggccaagtgcctaagtctggccacagaacaccgcgtgccgcgctaacctgcgtcctatccttagcccacggcccgtttgatagattgggtcgtacttcctacttcacgacgatgttaacgatccggtttggaatcacgatcaccttcttgacgtccttgccgtccacaaaggagtgaacgtgctcgttagccaaggcagcgtcttcaacgtccttgttatcggcgtccttagccatcttaatcttggcccggaccttcccgttaacctggacgatcatttcgacctcatcttccaccagggccttttcgtcataggttggccacggttggtaagtgatggtttctgattcgttgaattggctccacagttcttcggccaggtgcggcatcaacggcgcaatcatcttaacgaagccttccatgtattcaaccggtaagacatccaccttgtaggcctcgttgacaaagaccatcagttgggagatggcggtgttaaagtgcatccgttcaaagtcgtcggtcaccttcttaacggtttggttgtacaccttagtcaacttaccgtcgttgtaggtggacacccggtcgcgcaggtggttgttgtcgtccatcaagaggcgccaaacccgttgcacccacttgttggccccgtgcagacccttttcatcccacggtaccgattcttccagcggccccatgaacatttcgtacaggcgcagggtgtcggccccgtattggtcgacgatgtcatccgggttcaccacgttgcccttggacttggacatcttttcgtggttggaccccaggatcatcccctggttaaccaacttcatgaacggttccttggttggcaccagcccgaggtcgtagagaaccttgtgccagaaacgggcgtacaagaggtgtaagacggcgtgttcggctccccccacgtaaaggtcaaccggtgaccagtagtcgagggcttctttggaggcgaactccttatcgttggtcgggtcggtgtagcgtagccagtaccaagaagagccggcccactgtggcatcgtgttggtttcccgcttcccgtggcggccgttttcatcgtagacgttgacccagtcttcgatgttagctaacgggctttccccggtcccggacggttcaatgttgtcggtttccggcaggcgcaacggcaactcgtcttctggcactaatgaggtcgtgccgtcgtcccagtggataaccgggatcggttcaccccagtaacgttggcgcgagaagatccagtcacggagccggtagttaaccttcttgcccccgcagtcgtgttcttccagccattccaccatcttggccttagcttccttgatgtttaagccgtccaagaagccggagttgacgtgggcaccatcttcggtgtaggcctcttccccgttgaagccttcgaccaccggcgtgattggcaggttaaacttagtggcgaactcaaagtcccgttgatcaccggatggcaccgccatgaccgccccggtcccgtaggagttcaagacgtagtcggccgtccagattggtaactgttcgccgttaaccgggttgatgacgtaggaaccggtgaagaccccggtcttttccttgcttaactcggtccgttccaggtcggaacgccgggacgcctcttccttgtaggcgtcaacggcggccttttgttccggcgtcgtcagttggtcaaccagttcgttttccggtgccagcaccacgtaggaagcaccaaagagggtatcggcccgggtggtaaagacctcaatttcgaccccgtcgtggccaaccaccttaaacttgacgctggccccctctgaacggccgatccaattgcgttgcatttccttaacgctttccggccagtcaaccaggtccaaatcatcgatcaaacggtcggcgtaagcggtgatctttaagacccactgacgcatcggtacccggtaaactgggtaaccaccccgttcggtcttaccatcgacgacttcttcgttggcaaccacggtcccgcccatgaagtcgggtgcccagttaaccatgatttcatcttcgtaggctaaacccttcttgtagagctgctcaaagatccactgggtccacttgtagtagttcggatcggtcgtgttaacttcgcggtcccaatcgtaggaaaaaccaagtgattgaatttggtcgcggaagtggtcaacgttttggttagtgaagtcagccgggttgtgaccggtctttaaggcgtattgttccgccggcagcccaaaggcgtcccagcccatcgggtgtaagacgttgaagccctgcatccgcttgagccgtgacatcacgtcggtggccgtgtaaccttccgggtgaccaacgtgtaacccttgaccagacgggtacgggaacatgtctaaggcgtagtacttcttttggtccttgtccaaagtggccttaaaggtcttgtgttgcttccagtagcgttgccatttcttttcaatcgctttgtgatcgtatgccatgatcaaatcctccaatcaattcgcgtgactaaaccggaagggacaaaaaaacgccccgttgtgcttaacacaaacgggacgaatttctccgcggtaccacccatcgttccacgttgccgtggcccttagccccttaacgcgggaaacgaggacgactactggtttcaccgccctttagcggggtgagttcacccggcttgccctccacatttccagccccatgtggtctctttaagggtcgccccgggttacttttccccttccggtctgatattatggttaccactataccataaattttgacacgtgggcgctccttttaatttctttgttaaaaatgcgcacccttctggaggaccttttgaataaccattacaagtctttatcgttaaccattggcgccagcgccctggtgatctttttgctctgtgcgtggctggtaggaagccacgcaccagccctcaacgctaacgatgcggcgctccgttctttagttaacgcccaccgcactaactgggggaccgcctttttcacccacctcaccctagcttacaactccaccggtaccacgatcatcgccgggttcgtcaccctggtggctttgctcggctttagctggcgggccgggctccaggtcgccttaacggtcgccaccggctcttggcttaaccactacctcaagtccctttttcagcgcccgcggccaactaacgacgtcttgatgcactacggtggctggtccttcccctcggcccacgcggccctgagcgccctgacgatggggtgcttagtcctgttaatcttgcggaccaagtggccgactaagtaccgccaccccctggcaacgttggcggtcgtctttgcgcttttgatcggcttttcgcgcctctacgttggtgcccacttcttgtccgatgtcatcggtggttgggcgctagggattaccgtggtcgccttttttgacgccctctttcaccgcttcttaccctaccaggtccgctccgttcagcgggccaagcgtcgccgcccgcgcccacggtcaaaccggccccgggcccggcggtactaaataaggagagtggaaaataacctccgaagcaggtcgtatgactaagctaggacgaacggttggtgcggaccgcaccgttcttcgtccgtacttaggcactaggcctgcggttattgaccacgttttctgtctaacattcgtgaatatagtaaggggccaggagaaagctgtgctttcccctggcccctttaaggtttctaactatttcagctcctcagtgcggcactccccaccattggggcgcccaaccaacacgccttattgccggatctgaccgtccccggtgatctggtacttgatcgtcgttaactgggccaaccccattgggccccgtgcgtgaagcttttgggttgagatcccaatctcggcgccaaaaccaaactcactaccgtcggtgaagcgcgtcgaggcgttaacgtagacgcaggccgaatcaacccgctgttggaaggcccggccccgctccatgtccttggtgatgattgcctcggagtggtgggtcgagtgctggttaatccactggatggcctcatccaggtcgtcaaccaccttgacggccatgattaaatcgttatattcggtatcccaatcggcgtcggtggccggtaccaggtcactgacgatcgcccgggcccgctcatcaccgcgaacctcaaccccgtgttcccgcagggcggccaccaggcttggcaactgctcttcggccacggcctggtttaccaagagcttttcggcggcgttgcaaacggacgggcgttgcaccttggcgttgaccacgatcggtgcggccacggccaaatcggcgctctggtcgatataaatgtggcagttaccggccccggtttcaatcaccggcacggtcgccgtctccaacacccgggcgatcaagcccttgcccccacggggaatcaagacgtcgatgtagccggtgaggtgcatcatttccgtggcgaccgcgtgactttggtcctccaccagttgaaccgcatcctttggcaacccgctttccgtcagcgccgcttgcagacacgccacgatcgcttggttagaccgggcggcttccttgcccccacgcaggatcacggcgttgccggacttgagggtcaaggcggtggcgtcggcggtcacgtttggccgggcctcaaagatgattcccaccacccccaatggcacccgccgttggatgatctctaagccggcgtagttgacccagccgcggtcgatcttggccaccgggtcgtctaagttagcgacggtttctaggccggttgccatgtcgtcgattcgttgcggtgttaagcgtaagcggtcgacaaacttggccggcatctccttcgcactagcgaggtcagcctcgttagccgccaagatcgttgcttggccagcccgtaaggccgtggccatcttgagtaaggcgtcgtttttttgcttggtggttaattgcgctactacttgactagcttccttggcccgttggcccatttcttccatcatcgtcatggttaattcccctttccaaagcgagttccaatttccttaccggcaagtacgtccttaatgatcgccgggtccttaccgttacataaaatcatctgcttgcccgcagccaacatcgtcttagccgcccgcaacttggtcaccatccccccggttcccaggacgctgccactgcccccggcggccgcctccatttccggcgtcagctgttcgacgtggcgaatcaccttggcgtcggggtcttggtggggatcggcgtcgtaaaaggcgtcgatgtcagacaagacaatcagcttgcttgcgccaaccttgacggccacctgagccgataactcgtcgttgtccgaaaacatggtgtggtgatcgagttcgtcaacggcgaccgggtcgttttcgttgacgatcgggattaccttatcggccaagaggacctcgaaggtgtcgattacgtgttgcaagctaaccgggaaggtcaacacgtcccgggtaatcaggatctggccgaccttagtttggtaatccaagaagcgttgggagtagatccgcatcaactcggtttgcccaatcgaggctaaggcctgctggcgggcgatttccgccggccgcttggtcaagcccaaactggctaaccccaccccgatggccccggaagaaaccaggatcggttggtatccctggttgttaacgcaagctagggtaaaggctaaccggtcgatggaggctaggttgacccggccgttttcttggattaggctggaggtcccaatcttaaccacaattcgttctttatctgccataatcattctccttaaaacaaaagcccgccttcaattggggcacccttgcaggcggtaccatccccatttgaagacgagcttcacgcttttttaatttgattcggtttttggacttggtccagcgggtttcgaacgcatgggtcagcttgcagccggtgactgacctctctagacggttcttaattgttaatcatagggtacccgtttttttcgtaccggtcaagcaaagaaaaaaacgtggggaaggtcacaaatgacccccgccacgtttttcattggttattagcccaaaattttctttaattccgcaaccttgtctaacttttcccaaggcaagtcgatgtcggtccggccaaaatgaccgtaggcagcggtttgcttgtagattggccgttgtaagtcgagcatcttgataatcccagccggccggaggtcaaagacttgacgaacggcggcgatcatttcttcttcactcttggttccggtaccaaagttgtcaatcgaaattgaaaccggcttggccaccccaatcgcgtaggcaacttggatttccagcttctttgcgtagccagcggcaaccaagttcttggcgatgtagcgggcggcgtaactagccgaacggtccaccttggtggcgtccttaccggagaaggcccccccaccgtggtgagcggccccaccgtaagtatcgacgataatcttacgtccagttaacccggcgtccccttgcggaccaccaatcacgaagcggccggtcgggttaatgaagtacttggtttgatcgtccaggtattcagctggaatcacggccttgataacctgttccttaacgtctgcttggatttgttccagggaaacgtctgggtcgtgttgggtcgataagaccaccgtgtcgacccggaccggcttgccgtctgcatcgtattccaccgttacttcggccttggcgtccgggcgtaagtacttgatgaccttatccttgcgcaggatggcgatccgccgcatcaacttgtgggataagattagtggcagcggcatgtattcaggcgtttcatcggtggcaaagccaaacatcaacccctggtctccggccccaatttggtcgagtgggtctacttgaccctcccggatttctaaggagtcgtccaccccttgggcgatgtctttggactgttcatccagtgccacgatgacggcgcagttatccccgtcaaaaccgtacttaccgtccgtgtaaccaatctctttgatcgtttcacgcaccacgtgttggatgtcaacgtaggccgaggtcgaaatttccccgaagaccagggccaacccggtcgtcacggacgtttcaacggccacccgggcatccgggtccttttctaagagggcgtctaggatggcatcgctgatctggtcggcgatcttgtccgggtgcccctcggaaacggattctgacgtgaataagtgtcgttctttcatgtgataattcccccattttctaaacatagtgttttgcggttacaaggcagcggagcactgggctccccccatcgggaattgcttcataacaggggcaataatatcatatttttctattaactttcaattaaagattcgcaatctttgttatactaaggtcaatgtcaaaacctgaaaaggacgtgtaaatctaatgtggaatcaactcaaggcgcaggttcacgccaccgattggcaagaccttttgccgaccatctgcattcaattaattacctggtcatacgcccccttcgcctacgtggtcggcgttgacgggacccacttcaccagccatttcggcccgctttttttatatgaattatgcattggcgccgctattaccctggcgattaaccaccacttcgcctcccagctgtccttggtccccctggccttgagcgtaatcttcgctgggattggctttctcaagtcgccgatccttttgaccctcttgatcctcttgccggcctacctagtcttaatccagttgccgaacattgacctgcgcggggggctaaagctcgtcacccttggtatcctcatcaccttaaccatcccggttgcctgcgcctttacctcgacgcacttcatgtcctgggtgatcgtccgttactttgtgccgttggcctgttcaatctggtttttttacgggcccttttttatcaccaacgttaagcacttagtccccttcgaaagcgtgaccggccttttgtacgccgccgccattctctcccacccgctgagcgtggcgaccattttcgccctcattatttccttgggcgcttggttcatggtcatcttgcccaccacccgggaaaagtattggaactttgtttacgccaacctcgcccagttagtcacgatcgttttaatctactggacctaatcaaatcaaaaaggagctagcagggttattccctcctagcttcttttttgtgtgccgtaaactacttggccgtcaatgaccaccgccccaggcctaagcaaggcgggcgttgattaccccgaccgctgttaagtacgacatcaccaccaccgggccggtaaacttaaagccggcccgtttaaattcggtcgccacttgttcggacaggggcgtcttggccggtaagggcagccctggtaccggctccatgcgaatcgaacgcccgttggtaaaggaccaggtaaattgttccagggtgcgtccctcttggtgccactggcttaagattcgggcgttattgatcgtggcccgtaccttcaactggttgcggatcagggccgggtcggctaagagcttggcgacctcttcttcgccaaactgtgcaaccttggccggatcaaagccctggtaggcttctaacagggccgggcgcttttgccaaactaaggcccagctgagccccgattgaaagcactccaggcacagcatctcaaagagtttttgttcgtcgtgttgggcaaagccccagtcgtgatcgtagtaagcttgcatggctggcgacttttgcgcccattctggtcggttaaccatggcaatccctcctttaccctttaaatacggcaactttttttaattgggcttctttttcgtgtcttttaatagcaacgctaggaacagcccgaccagttcaacaagcaccatcagggaaaagaccgcccgaaagcccgtcaaactagcggccgagtggctaacaccgctttgaccaacccggttcgtcacgttggtcaacaccatggtggcgaccaccacccccgccgaaccaagcacctggcgaacggtggtaattaccgccgttccgtgggccaccaagcggtcgggtaaggcgttggcacccagggtaacggccggcatcatgacaaaggcgttgcccccttcaatcaccatcgcacaaaggagcattcccatcaagctgtgttgactaaccactaagattcccgccccccaaccgatgatgatcatcgccatcccgactaacatcgtcggcttaaagccaatccggtccgctagcttaccactgagcggattcaaaatcgataagaagaccgctccggggaccaggctcattccagacacaaagggactcacccccagtaccccttgatagtacagggggaagatgatcgtggtgacgattaaggcaatgtatgaaatcgaggtcaataaaacggccaagtcgtagttaaaggtttttaaaacgcggagctccagtagtggggtcgccagtttaagttggcggacgacaaaccaggcgagggccagcaggctaacggccagtggtgtcgcggccaggtcccaattgacccctgccttgcccacctggttgattccccacattaaaccaatcaagcccagcaggagaaacaccgacagccaatccaatttgctctggtggcgttccattatgtcttgaatcaggccggctcccgccaaggcgaagataacggtgatcacgatcataaagaagataaataggctctgccaggaaaaatacttgaggacaacaccggacacgatcggccccaccgctagggcggatcccattaccaagccagcaatccccatcgtggtgccccgctctttttccggggtaatttctagcaaaacggtctggtaagatgggaagagtaccccgacggcaaaggcctctagtacccggccaaccatcataaaccaaaagccagccgccccccaactaaccggggtcaaaacgatcaccaggctgcccaggtcaaagagggctaaggcgcccatgaacatctttttaaaggacaggttgtttagcatccaggggctaatcggcatcgcaacacacattaccagcataaagccggtcgttagccactgaacggtgctggccgaaataccaaagtcagccatcaaggtcgggtacgccgttgacagcgatgactggctgatcgacatcgtgaaggtccccaccaagagggtggccatgaaacccagccggttaaatgagtggctggagggctcaatttgcgtttccatcgaatcccttcttctttagaaaacttataaaattacattcgccccccattatatgtttggattttaaaaatgtaaatgctatactaaggttaatttaaaatgattataaaggagtgatcaaatggccaacgatgaattccaacacgccctcgagcggctacatgagcacaaggtacggttaaccccccaacgcaaagcgatcctccactacttgattgggcaccatacccacccaagcgtcgagatgatctacaacgatttaaaaaagactgacgacggcctttccatggccacggtttacaacaccctcaagatgttggtgacttacaacctagtgatcgaactggataacggcgatggcgccacccactacgattactttggtcgcccccacttccacgtggtttgcgactcctgtgctaagattaccgatgtgtttgacgagcgctttgccgacctcgctaagtcactcgggaccatcacccgcgatcaaaccggctacctggtcacccgtacggacgtggaggtccacggtctgtgcccggattgccaggctaagttgggcttggcacgctaaaaaagaagtgcctgacaacctctcagcaggccgtggggctaagctagggcgggggttgatgcgaaacgcatcgttctccgtccgtacttagacactaggcctgcggttgttggatacgttaatagaagtggccaacaatcagttagtaggccgtggggcgaaacttagagattaaaaaaggggctgtgacgcatgtcacagccccttttgtggtctctttaatgcaatttagttggtcgcttggacagggaaatgattcccagcgccgctaaccagatcacggccgagattaccgacggtaaggtttccttgctcatgcaaaggacaactgccgtggcggccatgaaggccaagaagaggtagtcggtaaacggggccagtggcatcttaaattcgcgttggcccgggttttgccggtggtacttcaggtgggccagaataatgctggtccagacgaataagaaggcggtcgtggtcatcgaggtcaccacggtgaagacttggctaggcaccaagtagtttaagatcaccgagcacccgacgacgatcaccgacacgatcacggccgtggccgggacctgctttttggagagcttagcaatccggcgtacgcttggccgtggcgagtcggaggtcagttccgctagcatccgcccggtcgtgtacaacgatgagttgcaggccgaagccgccgccgtgatcacgacgaagttcaccacggaggccgccccccgaatcccgatgtctttaaagaccattacgaagggcgactgggtcgggtccagcttgttccacgggtagatggccataatgattaacaaggccccgacgtaaaagagcaggatccgcactgggatgtcgttgatcgcccgcggaatcaccttgcgggggttttgggtttcggccgccgtcatcccaatcatttcgattccgacaaaggcaaagatgaccatttgaaaggacatcaaaaagcccttaaagccggtggcaaagaagccgccgtagtgcaccaggttccccgggttcgccccccggtaaccaatcaccattaaaacgatcccgacgatgatcagggccacaatggcaatgattttaatcagggcaaaccagaactcgacttccccaaaggccgataccgtaatcaggttcaagcacaagaggatgatcagggtcaacaaaccggggatccactggggtaaacccggcaaccacagtttgatgtaggtcccgatcgccgtaatctcggccatcgcaattccgacccaacagacccaataggtccacccggccacaaagccgacccgcggtcccatgtaatcgcggatcgcttcgataaaggtgtggtaacgtaagtctgataagagcagctcccctaacgcccgcatcaacaggaagaccatgcccccggtgatgatgtaagctaacaggattgacggaccggccgcgtgaatcgactggccagatcccaagaacaaccccgtcccaatcgttccccccagggcaattaattgaacgtggcggttcttgaggttgcgggccatctttggctcttcggacccgctggtttgctgatgatgatcagccatataatcctcattcctttcttctgtcgaatatggaagcttaattttcggcgctttctcaccgtacgttaatagaaacttcattatacaccatttcggtccccatgcgataggagaaatgtggtcgcttcaccactactaaaatctggtacactatccttgaggtgattattaatgatatcaaacgaacaacgggcccacgacatcgccctggccctgatggccaaaaatgccgaccccaagaacccgattgccgcctaccacgagtacgtgaccctgcttgtgccccttttaaaggagctcgaccgtgacttccctaaggggatcaactagggggccaacatggcagacaagcgactttttatcctcgcccaaccagacttccctaagacaaagggctttcaactcttaacccgctttatgcaagggcaccgggaaatcaaggttagtttcgccacccgcacggcccacctagctgcggccctagcaactggggaatgcgacctaatctttgcggccggtttgactaatcaggcccacgccctgattacggaccaagaaccctacctggccgtcttgcccaccccactagttagccaactggggctgtccatggccaccaccgttagtctagaccaactcgccgaacaagacctcctcttgcctagccagggtcacccgctccgccgggaactggacgctaattttaagatggccggtaccccgctgccgtcggtggaagaagaggacgccctcgacctgcgcttaactaaggttgcccaattcctgggggccacgcttgctccccagtcctctttaccaactgaattaccggtcggctgccaattattcggcctttccccggccctactcagttcccaaggcttcctagcccccgcccagccctctgaaacggcccgcgttttcctagaatggctccaagaacaaagcgggcaatagccttctagtagaccggttataaaatcaaaaagcggccaagagaattctcggtttctcttggccgctttcttgaatttgggttacataaataatttaataaaattatggaagggtaacctctttgccaatgaagtcgagggcgtttccttcccacggaaggtcgagaaccgtcattagtgcttccacgctttggttggtttgttggtaaagttcgtaagcaccgatccgttgggcgcagtcagcacaaaacggggtgccaatttggtcaccggtcttagcgacaatttcgtcaaatttcttaaaggacagcggttggttgcgagaagcttccagttctgggaacatgttggccgtggccttgcaagcgtcaaacaggtcgtgggcttctagcttctaaccactcccggtacatgttcagctcgtctagcatggcgccccagtacaccatcgtcgtccggccgtcttcgttagtgatcttggtcaaccaccactgactaaagtcagtggcttgtgagcaagcacccttctgatgagtgtttgaatcacaatttgcatagatacaccactgcgaacagttctacgaaccgtttcgtcttacatggcaattaccaatgcctttagcgtccccaggttgccatagggacgagccaaattaggctaatttaataattcctttagttagaatattctgcgcagcgttatggtcacgaacgtggtgagcatggcactttgggcatgtccattctcggtctgcaagtgtgagtttttcggtccctgctgtgcccatcacaaaaccacattcatggcaagcctgcgtagtgttcttaggattcaccgtaaggaattggcgatggtagagttctgctttataagccaacattcctaagaaagtccgccaacctacgtccgcaatactcatcgctaaagcatgattcttcagcatatttttactccgcaattcctctgcggctacgaaatcgtggttcttgattagtgtagtcgagacattgtggagaaagtcacgtcgacgttcaaagacttgggcgtgtaatttagccaccaacaagcgttgcttttggtagttcttactagtccgtaatggtcgatgttcttgtttggcccgacgagcccgtcgcgataagatgcgctgtgctttggctaagcgacccttaattatgcggtaatagcgtggattagccacagtatcgccattactagtagttaagaagttttcagtattaagatcaatcccaatctgcttgcctgtattttgcggccaattgacaaagggagtatccgacgctaactgcattgagagaaagaaacgaccgctagcgtcctttacgatggttaccgttccaatacgggtttcagcactgcgagctaagactcgttgatgggaacctttaacacggagccgacctaatttaggcactatcacatgcttactatcttcaaaatgtacagttccgttagttaagtatgctgccttctgtttcaaatactggcagttagtttgataacgccagacgtaacttttccggtgaaacttaggcacacctgcggtatgaactttgcgaaaagcattccaagctttatggtagttttgaatggcattggctttagtcaagctatcgatccttttatcttctaagaactggaaatgattagacatttgtttagcgctttggcgaagctccagttgctcaatccggttctgagtggtatcaatcgggagtttaacctgttttagccgccaaagttccttgttaatagcgaccatttcgttatagatgaatcgactagcatcactattgatcttgataattttcttttgcctgtcgcttggataaatccgcaccttgagtccgtaatgatatttcatctgcgccattgacttcatttattttcacctccttcactgatatagtgttattataccatatgtcaatgataataataattaaggagcgtggcaatcatgtcaaaggacaaaatcgaagataccatttatacacggcgttatatttataactttcactaccatttgatttgggtaaccaagtatcgtaatccaacttttactagtgaagcgttagtgaatgaaatgaaagaaatccttacaacggttgcggcagataacgaaatcgtgattgagcacatggaagtaatgcctgaccacgtccatgtgttgattagttttccacctagtaaagcaccaactagcgctatcaaagccctcaaaggacgcagtgccttcattttcctcaagcgacacccggaaatccgccagtcgcagtattggggtggccacctctggtcccctagctattacatgagtactttagggaatatgagcaaggaggtcgttgagcaatatatcaataatcaaaagtacaatgaaataaaaaaacgccctaaaggacgtaagtagaagcctatccatcccatgactaaagtcacgggatttccggccaatatttattaaagcaaaagcccctcaatgacatcaccaccaaagatatcattgaatccgctgaggccagtcgtaagaccttttacacatactacaaggataaacgcgacctgttaatggaaattgaaggggcgatcattaccgacttacaagaggccctaaaagaggaccgtaagtgcttaacccagcacagctcctttccagacaaggaagaaatcttccgcctctcccaggaatcctttgcccacaccgtccaggtttgcagcgattaccgggaagtcagccggatcctgttgtccccaaacagcgacattaacctgctcacccggatcaagcggaccacttactcggagttcatgcaccggggcaagcttttgttttacttcaatagtcagcacccctctactaatgttcacccgtcaccgatcccggttgactacctatttgaaatctacaccgggactttgaccaacattattgtccactgggtacgttccgataaccggatctcaaccagcgccctgcgtgagatcatggggtacgcccaaacccactccccggtggaattgatctacttgactaactttgacgagcaagccgaccccgatcaaccaagcaccacttcaactcctaatcgcaaaaagagtggccaatcacctttgcccctgcttaaacacgtgggctttggttgttggccactttttttctgcctatcatttgcaaccacaacaaaaggctgagagcaatgagcgttctcagccttttctgcgtgctaccacacactttaattagtcaatttcaatgtgtttaccatcattagcctgcttagtcagcttaggcagggtcaaaatcaagaccccatcggtgtacttagcgttaacctgttccaagtccacccctggcaagcggtactgacggctcatctgcccgtaacggcgttcggagtggaggatgttcccatccttgtcggactcatcatcgaaggtgtcacggtgaccggtgaccgtcaggaggtcgtcattgtaggaaatgtgaatgtctttcttgtcaaagcctggcatgtcaaccttaacccggtattgcttagcggtttcctcaatgtcggtcttcatgtagttactgttaaacggcaggttgacgttgttaaagaagttgttgtcaaaccaatcttgcatcatgtcaccaaagaggccgttgttacgttgtaattcatttgccatgataagacttcctttcacgaatctttttatatttccttcaacatctttatcatagcacatttaattgcaggtgcaagcccctttagcagtgcgagttgttaactgctaaatcacggctttggctgactcgctaatcacccgtcaaccggctttttggtgctttggacccccactttttaaatatttattttttgataatatgaacaaaaaatcatttatctaagttgacgtgggcgttgacggcggccaggttttctcgttccgtccgccggtgctcacggcggttttggtaggtctccatcaaaaaggcttgctcatcatcttcgccaattaaacggtaatcggtgaagttggcagcctcatcgatggccacgtaggtcataaagcacgaaaagccaagggtgcgcttgccggtggccatttcctcaacgatcaccttagcaaagacctcaattgaccgcttaccgatcccggttacaaaggcctggagttcggccgcgtcccccaggacaaagggccgggtaaactgaacgtgatccatgctagcggtcaccaccgtcccccgggccagccggaccgccgccagggaggcctcggcatcgaccatggcgagtaacttccccccaaacatcgtctcgtgttcatttaaatcggcgctcattacccggtgggtcgtcaccacccgggtctggttacaagtaatttcttttaccacgttggcacccctttcattttccttctattgtacccgactaaggtcccctttggacaccccaaccttaaaaacgaaaaaagaccgggagattagcgttcccggtctttttatcaatgttctctgatctgttgggtactagatcgcactcctattttagtaccaacggtggctttcccagaaggcttgggctgcggtccaagagccgtaacgggaggctacgtattggtcagccaccttttcttggttagcggccgacaggtccccatttaagtaggagatggaaagttggtacttcccgtagtagttaccgttttgtttggtgtaagaaccaccggattccttttgggcgatccattccttcgctgcttcttcagatgagctcaggctagtcgtgtaggagctggtgctggaagtcgaagtggttgtagaagtggctgccatcgtcgtgtaggccgttgaggtagcggcggcactttggctagcggcctgttggctttgtagggcggcttggctggctgcggcggcgctggcggcagcttcactagcggtggcttggctagcggcagcggcactttgggcagcggctaaactatctgcgctagcttggtcagaggcagtcgaacttgcttggctagcggcggaggcactgtcggtttgggcttggctagttgaactagcgctagcggacggcagtgaggccacttgactggcggtggccgaagcaatttcaccgtcatctttgatcactaacttttgcccgacgtagatcaggttcttgttagcgatgttgttgttggaggcgagcgtgtcaacgaaggcataatcgtgaccgaactggcaagaaattccggaaagcgtgtccccactcttaacggtgtaaattgaatcggcatttgcggacaccgtcgttgcaacggttcccaacgcaacggcgccggcgacagttgcggtaagtttcaaggctttcttattgagcttcattaaaatgaatcctttctttcgtatcagtatttgttcgtcgttcctatgctgattactatacccgccttttgttaccgcgcagtgacaagcagttctcaatcggccgccactttgtaactttccgtaacaagcttaattcaaacggcaacacccgttcggggttcgaggccatggaggcgtataggttgaccacccttttcacctcggtcccccgcccgtttggtttttgtaacatttcaccccagtttggcgccaaaatttttcccaattccccctcgttaagtgaaaatccccggtttttcgccgtttttgttacattgccgtaatctgcaacaaaggaccccctgaactaaaaacagcggctgggtaaaccccaaccgctgtttctactaaataaaggtgttgaaattagtcgatgtcgttgcagattacgaccggcttaattaagtccgccggcttgtggtgcatcagttcgatagcgtccggaatcttctcgaagccttcgaagcggtgggtgatcatcagtgatggatcgatccggccgtttacgactagttgagctagcttttccatccgcaggcggccaccaggcatcaggccaccgtggatggtcttgtgacccatcccaacaccccagtcaccggcgttgaagaccacgtcgtcgtgaccatttaggtagttgacgttcccaattgaaccacccggcttgagcatccggacggcttcttcaaaggtatcggcggcgttcccaccggcgatcaggaccttgtcgaccccttggccgttagtggcttctaggatttggtcggagatccggccgttgtggtaatccacggtgtcggttgccccgtacttcttggccacttcgaccgtcttttcccgtgaaccaaccgcaaagacgcggccggcaccgtggagcaccgccccgcgcagggccatcaaaccaaccggtccgatcccgatcacggccacggcgtccccaaaggttacgcccgccattttggaagcgtggaggccagttgggatcatgtcggaaagcatgcaggcttccgccgggtcgatttcctttggtaagagggccaggttcccgtcggcgtcgttaacgtggatccgggtggagaaaaccccatccttaatgttggagaacttccagccacccaacatcccgtcggagtcagtagcgtagccggcttgggagtaaacgtcggaccagttcggcgtgattgccggaatcaaaacccggtcaccaaccttgaagtccttgacttcgctaccgacttccacgatctccccgcagtcttcgtggccgaggatcatgttctcccgcggccctaaagcgtcttcgaaaacggtgtggatgtcagaggtacacggggcaacggtgagcagccgcaccagggcgtcacgactccccaccttcggatcttctttttcaataaagcccgtttgttaactttttaacatattttattaataatggtgcagcgcccttatatcaacgttaaccacgaaaacacccccaccatttagcgactaagtgatcgtcaaatcgtgagggtggtgaatttttctacaaaattaagttaggctaacttgttgtgccgtgacggcatcaagaggttcaagacaatcgccgtgatcgccgctaccgcgatcggtgaccccagtaagtattggatcatttgtggggccgcgttggttaccttgcttggcaagaggaccagggccaaggtcaaaatgatcggtaagccgatgatgtacaggtcggattcgccggtttgttgctggcgaatgacgttcaacccgttgagcatgatcgtcacggtgatgatcgcaaagacccccccgattaccggcgccggaattgccgccaagaaggcggacaacttggcgaagaagcccaagacgataaaccagctcccggcggcgatgaagacccgcttggaggcgaccccggtgatggagatcaccccggcgttggtcgagtaaccagttaccggcgtcgttccggccagggcggctactaaacaggagagtccttcgccgatgatcccgtggttccactggcgactcgtaatcttgtggttggtaacggcccccatcgcaaaccaggtcccggtcgtttccgtggtcaggatggcgtagatgatgatgaaggtcagaatcgaagttaggttaaaggaaatcccccagtgtagcatcgtccgttgtgggaaggagaaccaagccgaatcggccaccgacttccaatcaaagcggcccatcgaagcggacaccagtgtccccaccaggagggcgatcacgatcgaaccggtcttaaacagcttttgcacccgcgggaagcgaatcgaaatcgccacgcaaattaagagggtgagggccgtaatggaggccagttcgatgttttggtaaatgttacccgtcgcctcaaagatgttgtcgtttaaggccgaggggatcaaagacaggcccacgcaggtgatgatcgttccgccgaccaccgccggcaccagggtgttgatgatcttttgaaaggccccggataaaccgagcaagactaagacgatcgccccgaccacgagggcacccagcagggttgccatcccgttgcccttcaggcctcccgacgccatgacgaccccagcggcggcccccagcggcacaaaggacggcccctgcgaaaccggcatcttcataaagaagcaggtttgcaaaatcgtcccgatcccggccgccaggaaggtcgattgcaacagccccgttgaatcggcggcccccatcgccatcatcccggctaaaatgatcggcggcacgtagacatccatcgccaggacgtgttgcaaccctagtaaggtcgcctcgccagccggcaccggatcgtccgggccaacaatcagtgaactctcaacttgattttccattttctctctctttccgcagcgaacttgctgccctttgcttaggtaatgttaagattttagcacctccatccccgaatgtaaatatgattgttcgcctaaaaaagcatttaccccattgtttggaggtaaatgcttttacatagttcggattttaatggaagcgctgactgacccggtcgaccatgatccgtggggcggtggccgctagggccttcactaaggccgttgggtcggcgaaggcccgctggctaaattggacccccgccgccgggccagccgtcttaaagtgcggctcaatctgcgggaagctgtcctcatcgaccaggctaaggagttggtagtctgcttgcgccccctgtccgtccagccagttggtcaaccgggtgacctgggccgggtggctacctaacaccgtcgtcaccgctaactggctgtactgggcctggtagcaagccaccacttggcggctcacccgggccccgaagttactgagctggtagaagttaacgtgggctcgttcccccagtagcaattccgtggcgtgaaaggacggcttggtggtcgccattggctggtcgtcaatgatcgtcaccgtcgcccccgcccccaccaagatcaaatcgtgaacattggggtgggaatgttccccggccagcacgaccggcgccgggcgttcggttccgtcggggacgtacaagaagcgccccccgtttaacagggctaagtgggcggcgttttcctggttaccctgccaagcaagggccttttccattaggttttcttgcaggagttcactgaattggggcgccacgttcaagagcggttgttccactaggtcgccgaccccccgactggtcccttgttcaacacctaagtcggggtcggtttgccagtcggctaacaaagccggggcgccggccgccaggcggtcaaatagccgcaaagcaagctggcgtttctggcctagccacggggcggtctgggcgctggcccgttcaaccaaagcaattaattcgtcgttcataaggccccctagtgcaccagcttatcccagataacgacttccccggttgccaaggacttagggacgtcaatgatccgctggttggaactcccccgaaactgaagggtcaggtcctttttggccaacaagaagcgcccgtcgaccaggatgtcgatcaaggacagcatctccagtttgtctgcggaatcttgtaacagctcttcccaggtgtaacccgaccacgaccagatgtctttttggtggccaaattcctggcggacccgcttaatcaatttcaagcagacctgggtgtttaaaaagggctccccgcccaagagggtcagcccttggacgtagtcgtgacccaggtcttcaatgatctgatcttccaattcttgcgtgtagggggtgccatagtggaagttttgggccgccttgttgtagcaacccgggcagttaaagaggcacccggacacgtaaaggctgcaccgaaccccttccccgtcgacgaagttaaagggtttgtaatcggcgatgtattgttgtgaatggtccttagcgagccattctttgggcatcggattgtttggctctctcaaacgctgcggcatgcttaatcattcctcctgtcatgtgcttagcccggtggataatttcctcgtggcgcccgtggaccattggccgttgctgggggttacctaagtagccacaggtccgcttgaccacgtcacaggtcgccggatcgtggttaccacaattagggcacttgaagccctgggcggtcgcttcgaattcgcccttaaaaccgcattcaaagcactggtcgatggaagtgttggttcccaggtaaccgacgtgatcgtaggcccagtcccaaacggcttctaaggcctttgggttttggcgcaggttcgggtattcgcagtagtgaatgaaacccccaccggcgtacttggggaagtcctcttcaaaggccagcttttcaaacggggtcgggtgcttgcggacgtcatagtggaaggagttggtgtagtattccttgtcggtgacgtcctcgaccttgccaaagcgcttgaggtcgtcttggcagaaggtgtcggtcaaagattcggccggggtcgagtagaggctaaagtggtagccctcctctttttcccagtcggcacacaggtcgtgcatccgcttggcgatctctaagacaaagtcgtgggccgctgggctatcttcccacttcgggccaaagaaggtcgccccgacctcgtataatccgatgtagcccagcgaaacggtcgcccgggagttcttgaagacctcatcgaccgaatcggtccgcttcaagcgcttaccaaaggccccgtacatgtacagtaacggcgcgttttccggcttggcttgcttggtccgctcgattcggtaatcaagggcgagcttggccaggcgcatcttttcgtcaaagatctgccagaacagctcccggttgccccgggcttccagggcgatccgcggcaggttgaccgtcacgacccccaggttcatccggccggagttgacctccttgccgttttcgtcttcccagccctgcaaaaaggagcggcagcccatcggggtcttaaaggagccggtcaactccttgatcttgtcgtacatcaacaggtccgggtacatccgcttggtcgaacactccagggccagttgcttaatgtcgtagttggggtcggtcgggttcaggttgaggccgcgcttgacggtgaaggtcaacttcgggaagatcgccgtccggtgttccttgcccaagcccttaatccggatttgtaagatcgccctttggatttcgcgggccacccaggaagtccccaggccaaagttaatcgtggtaaacggcgtctgcccctgggaggagtagagggtgttgatctcgtattccagggcctgcatggcgtcgtaaatgtcctttttagtcttggtcttggcgtattcttcttgcttgtcttctgccacccactgcttggcgtcggccaggtgcttttggtagttcttcatcgcgtagggttccaacaattggtcgatccggttggccgaacagcccccgtactgcagggaagcgacgttagcgatgatctgtgacatctgggcggtggcggtttgaatcgactttggcgagtcgacccaggcgttgccgatcttgaaaccgttggccagcatctcgtcaaaatcaatcaggcagcagttggtttccggggtgaccggggagtagtcgaggtcgtgccagtgaatgtcgccacgcaggtgggccttagccacgacttcgggcatcatcttgagccctagcgcccgggacaccaccccggcctccaggtcccgttgggtgttgaagaccttgctgtccttattggcgttttcgtggacgacccgcgagttctcatcaaagagttggttaagcttttgctgggggtcggtggccttgtcaaagctggcgtcgtcttggcggcggtgctcggtgaaggcggtcgccaggtcggtgcgcccagcccggttcaaggcggcgcaaatcgcgttagcaatctctgcggtcgtgaccgttgcctggtcactaaaggcgttgactaaaaaccagctaacgtttttagtgagttgctcatcggcgcccagggcccgcatgaccatcccaatcttgtagccgtaaaagggggtcttggtctgaccccgtttgatgaccgtgacgtcgcttaagggcgccagggtttggttagtaatgatttcttgcatcttgatcattcctttcgcgttcaatcattatcatacgggactccccagttcgacacaacatctagtttttgggtaatcgttaattacaagatcttgtggtcaaagtcaaacaatcggccacttagtccttttcccggtttcacttagcggaccaaagtgagctccacccctactcgttccccggtcgccccccttttcgcggttcagtcaaccgttccaaagtcggggcgtcgctatttttaattaatcgatcgataaggataaaaacggcgcccagctttattttggaccatgaaccccccttcattttgacccccgaagcgcaaaaaagagccgtgaccttttcgtcacgactcccttatttcgttatccgttagcctaattcgtacttagcgcccatccgccgttccagccagcccagtaattgggccatcgcctgggtgaggatgaagtagatcacggcggccactaacagaggcgggatgaagttgtacaaggttccccccaccccgagtgcttcggcagtgatttcttgcaccccgatgtagaagaggacggatgattccttaatcagggtgatgaattcgttccccatcgccggtaagacgttgcggagggcttggggcagcacaatcgagaacatggtttccttttgacttagccccaacgacaagcccgcttcggtttggccggccgggatggagatgatcccggaccggaagatttcggccgtgtaggccccggagttaagccctaaggcaatcgcccccgggatgatccggtccagtcccgaccccaaaatttgggtctgcggtagtggcaaggaacgggccaacaggtagtagatcaacatcacttggatcatcgacggggttccccgcacgatagcgatgtaggcccgtgcaatccatgaaatcggctttaccttggacatccgcatcaggaccatcaagaggccgatcaagaagccgatgatgaccccgatgatggagatgatcatcgtctgggcggtcccctctaaaaagagcggccaatattgtcctagaaaatcaaacatgtgcaatccccctgttaactaactacttgttggtgttttgttcttgaatctcttgtgccttcttgaagagcttgtctaattcgccggacttttgcagcttggtgatttccttgttgacggcagcctttaacttcggttcgtcctttggaatggcgattgaaatttccttcatggatgccggtgccgtgatcttaaccttggcgatggcgtaagtgtccgggtattgggcaacgtattgttccgcgaccttcttggctaagacgaccccgtcgagcttaccggacttcaggtcggtcgctaacccggtgactaagctttcggaaaccagcttcgccttggtttgggtcttagcgatcgtttcctgggtggatgattgttgaaccccgaaggaagcgcccttcgtgtcggcgatcgtgttgtacttatcggcgtcggccttcttaactaggagggattcttgttccgtgtagtacggcttagaaaagtccacggcctttttccgttgtggcgtcacgttcatcccggccagggcgatgtcgaccttgtgatcttgcaactcgctaataatggaggagaattccatgttttgcaccttgagcttaaccccgaggctgtcagcgatcttttgggcaaccatgatgtcgtaaccgacgtattccttcttcccgttcttcatgatcgtgaattcaaacggggcgtagtcggcggaggtccccatcgtcaagaccttcttgtccttgatttgttgcaggctatcgtcactcttcttcccacacccggcgagcccaatcaccaccaagaatgctaacgacagtagcgccaaccatttcttattaaccttcatattaatgatcctctttcctcaattgaataatcattgtatatatcttgaatatgttttatatagtaccgcctttcttgcaaagaggcaagtcttttttaataaaaatacgatctttttcggtggatatgcgataaatacgtatatttcatcccgtgatatacaatttaattcaacccgaaataaccatcaatccccgtcgacaccgttttcattcaccaaatagtgcttaattgattattcatcaccactccgttgttccaattactagttggagttgttaaagcttactaaaaggacccccactattatcaagaagacgcctaaccactgagctagggccacccgttcgtggtacacgaattgccccagtaacgtcgccgctataattccaagcgccgcccagattggctccgctacgcttaggggtaatttttggtacgacaacgccattaggtatgaactactcggccataaatgaccgagcttctgggaacacgaagtagtatttaggatgttgcttctgtattcagaatacctaacttacagaactccgttcttttaccacggctagtccctagccaacggcttttaatcctctatggagtatattaactgccgcattaatatctcgatcgtgatgagtaccacatttaggacaagtccattctctaatttcaagtggtttcttcccactatggtaaccacacgtgctacagatctgactggtgtaattaggattaacagtaattaactgtttaccgtaccaatcacacttgtattccagcatggttctaaattggtaccaactggcattcgcaatagctttagctaaatggtgattcttttgtagattcttggctttcaaatcttcaatgacaatcacatcgtattttttaactaaggctgttgttagtttgtgtaagtaatcttgacgttggttcgctatccgttgttggtagcgagccttttgtttttgagcccgttgccaattctgataatcattgagatccatttttacgtctttatgattatggttccattggcaaacagctacggttgcttgatattttcggcgactatacttgctttgccactttgtggcttgcttttccaaccacttagcattgaaagtaccaaacttttcaccgtcagaactaatcgctaagtcagcgatcccaacatccaggccaacggtcttgcctgtttttggcaatgcttctggagcaacagtctcgacctgcaaagataagtagtagcgaccagttggaccatagctgacggtataacgcttaattttgccatttacagcttgagaggtcttactagttcgaatgcttcctaacttaggtagcttcattcttctcttggcaatcactgtgcagaccgaccgaccagtatatgactgtttggcggcgtgcctgcttttaaagcgtggatagccaccacgatgtttaaacagcatcttaaaagcttggactagattatggttcaccacaaggaaactagtcgcatcgctgtctttgagatagggatattcttgtttcaactgtttaagcaagtaattcattccatattcggtcaagtccaaaatgttggtgtaaattaaattccgcgaatttatcatttcacaagcttaagcataccggcttcttctgaattgtcatctttttcaatcccgtggtaaacggtcatgtttaagtaccgtggaccagcagcccatttttcattctgttcaatcagtagtgctcccattagtcgcaagacgctcagatcattcgggaatatccggattacacggtcacgacgacggatttcttgattaacccgctcaattgtattattcgtccggagacgcttccttagctcctctgggagctggtaaatcaccattaattcgtcaaaactattttctaatttcttcaccaccttagggaactcggtctgccaatctttaaccaattggtcacgccgttcaaccgcttggtcgtacgttggagcattaaataaatctttgagtcggttagcaacttctttacgatccttgagtgccagaatacttgtacagtcattactaaaatgaaattgacatctctgccaaaggctaccctgaaattgcgtagtgattgcatcctttaagccataatgagcgtctgaaacaaacatatcaatgttggtaaggccccgctgtttaagttcactaaagaagtccatccatgcagcttttgattcactatcaccgatatcaaaaccgagcacttctcgacgaccgctagggtcgattccaatcgcaacgagtaagctattacttgtcacaacgtgaccacggtgtaccttaaataaaattacatcggcatacacaaaagcatacttttgcgtaaggggacgtcggttaaaatccagcacttggtcgtccaaattattgcataaagccgagaccgtacttttagaaaaggttgtcccacataacttcttagtaatctcagctactttacgtgttgaaacaccttggattaccatttccattaatgccaaatcaaaggcctgctcactacgctggtagcgcttgaacagctgtgttgaaaaattgccatgacggagtttaggaacgtgtagttcaagtgttcctactcgtgtggtaagctgacgaacccgataaccattccgtgaattggttcgctcatccgaacgttcataagccttagctttaatctgctcagtcgcttcggacttaagaatttcatcaaggatcttggccataattgattgcatggccttatcccgatcacctagtaatagttcctttaattcgtcatcttctaaatttaattcaacttttggcataatgaagttcctttcagatttcacaaagtcctatttagaatttacaccaattatacggacataaccccatattcatttacaaaatgactgctaggattgttttgatagcgttgcttagccatatctagcatgagattccacactctacggtcattgccgaacatttgccatagttgagcttgttgttgcttgttagggtacaagcgtagcttgacccctttaattaatttggtcattctaatttcacctcctttttgcgttgatcatcaatatacttggctactgcttgttcattaacgctcccaatgctttcaacataataacttggtgaccataggtgacgaccttgctttttccagtagctagtttggagttctggacattctcggaagaggtgccgtgcagaaatgcctttaagccagcgcatgatgttagttacagacagttttggcggagcgctcactagtaagtggatatggtcatctttaccaatctccatatgagcaatcgtaaatccatattttgaagctatatcatataatgattgcttcaagacttcttctacgtgtcctttcaacactttattacgatatttagttccccaaattaaatgataattaagattgtagactgacgttctaccatatgtaattctttttgtatctttcataccaataattatattacattacggttcgatcatgtgccctaagggcacaaaaaaaggcaattcatcacgtccttaaaagaacgtgtttccttgcccgctttcaaaaaaggggagcaaaacatggttgatcgtcgcagtcgccggagccaacgtctcattaaagaggccttttaccgcctcatcgtccaaaaaccactctttcgcctgacggtggctgaaatcacccgggaagctgacctggggcgggggccattaccacgatgtctttgacctctacgaccaggagttggctgctcacgtcgatacgttactggccctctttaaaaggcattatctaaccgcctttgataagcatgactttgtccccttgttttcatccattatcaactacctaaccaccaaccaggagcttcaggccctaatgcacgaagcctacaaccaatcccggccgctggccgaaataacgcacgcctttcaaaccaccgttggggtaattcgttgacaggatttttaggttttgaggacacaaaaaaagacgccccgaaggacgccttggaactgaatattacacgagatgcttaaaggcaataagccatggaatgcctccggtgggggtcgaacccacactcccaaacgggaactggattttgagtccagcgcgtctgccaattccgccacagaggcaagataacaaaggtggtaaccggattcgaaccggtgatgaaggttttgcagacctgtgccttaccacttggctataccaccattgagcatctactattcaattcatacaattagacgggcattaccccgtctaatcagaagggcggtatgtgggattcgaacccacgcatgtcggacccacaaaccgatgtgttaaccaaacttcaccaataccgccaaaatattcagttgagcagggatagtaggaatcgaacccacaacgacggttttggagaccgtagttataccgtttaactatatccctataataaagtggaggagagtggattcgaaccaccgaaccaagaggaacggttttacagaccgtcgcgtttaaccagacttcgctactcctccatcaatggcgcaggacggaatcgaaccgccgacacatggagcttcaatccattgctctaccaactgagctactgagccatcgtggtgtaggtttgcaaccaaatggttgcgatggaggatacagggctcgaacctgtgaccctctgcttgtaaggcagacgctctcccaactgagctaatcctccaaaaagtgacccgtacgggattcgaacccatgataccaccgtgaaagggtggtgtcttaaccacttgaccaacgggtcataaacggagagtaagggattcgaacccttgatacaggctttaacccgtatacagcatttccaatgctgctccttcggccagctcggacaactctccaattcgcgtggcaacgtcctatcctcgcagggggcgatcccccaactacttttggcgtgctgaagcttaacttctgtgttcggcatgggaacaggtgtatccttcaggccatcatcaccacactttgaaagcttgtgctttcaaaactaaacaatatcttttcttatcaagaatcctcacacctgacttggttaagtcctcgaccgattagtaatggtccgctccatgcgtcaccgcacttccacttccatcctatctaccacatcatctctgtggggtcttacttccaaaggaatgggaaatctcatcttgaggcgagtttcacacttagatgctttcagcgtttatctcatccatacatagctacccagcgatgctcctggcggaacaactggtacaccagcggtatgtccatcccggtcctctcgtactaaggacaggtcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatgcggaaccaccggatcactaagcccgactttcgtccctgctcgacctgtctgtctcgcagtcaagctcgcttgtgcctttacactctgcgaatgatttccaaccattctgagcgaacctttgggcgcctccgttaccttttgggaggcgaccgccccagtcaaactgcccacctgacactgtctcccaccacgatcagtggtgcgggttagagtggtcataatacaagggtagtatcccaccaatgcctccaccgaaactagcgtcccggtttctacggctcctacctatcctgtacaagtagtacaaacactcaatatcaagctacagtaaagctccatggggtctttccgtcctgtcgcgggtagcctgcatcttcacaggcaattcaatttcaccgagtctctcgttgagacagtgcccagatcgttacgcctttcgtgcgggtcggaacttacccgacaaggaatttcgctaccttaggaccgttatagttacggccgccgtttactggggcttcaattcagggcttcgccgaagctaactcttccttttaaccttccagcaccgggcaggcgtcagcccctatacttcatcttacgattttgcagaaacctgtgtttttgataaacagtcgcctgggccttttcactgcggctggtcttgcgaccagcaccccttctcccgaagttacggggtcattttgccgagttccttaacgagagttcactcgctcaccttaggattctctcctcgactacctgtgtcggtttgcggtacgggcagttaaatactcactagaagcttttctcggcagtgtgacatcggcaacttcgctactttaatttcgctccccatcacagcttgtcaacccggcttaaagcatttgactctaaacctgacttactgcttggccagacacttccaatcgtctggtttgcttagcctcctgcgtccctccatcattcaaacgcatttaactggtacaggaatctcaacctgttatccatcgactacgcctctcggcctcgccttaggtcccgacttaccctgggaggacgagccttccccaggaaaccttagtcattcggtggacaggattctcacctgtctttcgctactcataccggcattctcacttctaagcgctccactagtcctcacggtctaacttcgtcgcccttagaacgctctcctatcacgtgtccagaaggacacatccacagtttcggtaatatgcttagccccggtacattttcggcgcagaatcactcgactagtgagctattacgcactctttaaatgatggctgcttctgagccaacatcctagttgtctatgcaactccacatccttttccacttagcatatatttagggaccttaactggtaatctgggctgttcccctttcgacggtggatcttatcactcatcgtctgactcccggacataaatcattggcattcggagtttatctgaagtcggtaacccatgacgggcccctcgtccaaacagtgctctacctccaagattctcgattccgaggctccccctaaagagatttcggagagaaccagctatctccaagttcgtttggaatttcaccgctacccacacctcatcccagcctttttcaacagacacgggttcgggcctccagtgcgttttaccgcaccttcaccctggacatgggtaggtcacctggtttcgggtacataactacgtacttcgtacgcccatttcagactcgctttcgctgcggctccggtttttccaccttaaccttgcacgtaatcatgactcgccggttcattctgcaagaggcacgccgtcacccattaacgggctccgacagcttgtaggcacatggtttcaggaactatttcactcccctcccggggtgcttttcacctttccctcacggtactggttcactatcggtcactagggagtatttagccttgcgagatggtcctcgcggattccgacggggtttcacgtgtcccgccgtactcaggatcctgaacggagagaaccaggtttcgtctactggactatcaccatctctggtgtggcttcccagccacttcgactacctgattctttggtaactccaaagttcagtcctacaaccccactgagcaagctcagtggtttgggctcttcccgtttcgctcgccgctactcagggaatcgaattttctttctcttcctgcagctactaagatgtttcagttcactgcgtctacctcttggcagctatgaattcactgctcaagtaatcatcgactaagatgattgggtttccccattcggaaatctccggatcaaagcgtacttaccgctccccgaagcatatcggtgttagtcccgtccttcatcggctcctagtaccaaggcattcaccatgcgcccttcataacttaaccttactgatcgtagatcagtcaagttagttgagtatgcgattataattcgttaaaaactcaaataacgcggtgttctcggttttcttgattttattagaaattgatattatttagttttcaaagtacaaactcgctaacctcgcggctagcaatggagaatatcgggatcgaaccgatgacctcctgcttgcaaagcaggtgctctcccagctgagctaattccccatgatgggcctaagtggactcgaaccaccgacctcacgcttatcaggcgtgcgctctaaccaactgagctataggcccaataagcgatgataaatcatcttgagaagtaaacctctcaaaactgaacactgtttcgacaatgtgtaggtttccgattaattccttagaaaggaggtgatccagccgcaggttctcctacggctaccttgttacgacttcaccctaatcatctgtcccaccttaggcggctggctcctaaaaggttaccccaccgactttgggtgttacaaactctcatggtgtgacgggcggtgtgtacaaggcccgggaacgtattcaccgcggcatgctgatccgcgattactagcgattccgacttcgtgcaggcgagttgcagcctgcagtccgaactgagaacggttttaagagatttgcttgccctcgcgagttcgcgactcgttgtaccgtccattgtagcacgtgtgtagcccaggtcataaggggcatgatgatctgacgtcgtccccaccttcctccggtttgtcaccggcagtctcactagagtgcccaacttaatgctggcaactagtaacaagggttgcgctcgttgcgggacttaacccaacatctcacgacacgagctgacgacgaccatgcaccacctgtcattgcgttcccgaaggaaacgccctatctctagggttggcgcaagatgtcaagacctggtaaggttcttcgcgtagcttcgaattaaaccacatgctccaccgcttgtgcgggcccccgtcaattcctttgagtttcaaccttgcggtcgtactccccaggcggagtgcttaatgcgttagctccggcactgaagggcggaaaccctccaacacctagcactcatcgtttacggcatggactaccagggtatctaatcctgttcgctacccatgctttcgagtctcagcgtcagttgcagaccaggtagccgccttcgccactggtgttcttccatatatctacgcattccaccgctacacatggagttccactaccctcttctgcactcaagttatccagtttccgatgcacttctccggttaagccgaaggctttcacatcagacttagaaaaccgcctgcactctctttacgcccaataaatccggataacgcttgccacctacgtattaccgcggctgctggcacgtagttagccgtgactttctggttaaataccgtcaacgtatgaacagttactctcatacgtgttcttctttaacaacagagctttacgagccgaaacccttcttcactcacgcggtgttgctccatcaggcttgcgcccattgtggaagattccctactgctgcctcccgtaggagtatgggccgtgtctcagtcccattgtggccgatcagtctctcaactcggctatgcatcatcgccttggtaggccgttaccccaccaacaagctaatgcaccgcaggtccatccagaagtgatagcgagaagccatcttttaagcgttgttcatgcgaacaacgctgttatgcggtattagcatctgtttccaaatgttgtcccccgcttctgggcaggttacctacgtgttactcacccgtccgccactcgttggcgaccaaaatcaatcaggtgcaagcaccatcaatcaattgggccaacgcgttcgacttgcatgtattaggcacaccgccggcgttcatcctgagccaggatcaaactctcatacaaaataagaagcttgaatagctctttttaataaattaagcgaattgacttcgcaaatgtttttgcctcgatcattaagatcaaggaccctacacatttgattcgtcgaaacattattcagttttcaaaggtctaccgccgaccagcttagccagccggcttaaatattttatcataagcgctaatgtgttgtcaagatattttttaaattctttttaactcattggcaccgctgatttaacagcttaatcaatatatcatatcagacaattaactgtcaacactgttttttgaaggattttacaaggttaacttcatgtcgtccttgcttatcacaacgattaaatactataccagtgactttttaaatcgtcaacgctttttggcaaaaaagttaaaaacgttggcgaaaatcttctagacagtcatagacctcaatggccgccaagtcaagttgatcgaacaccatcacgtcacctggttcaattcgcttgacgacaaactccccgctctcctgattgaagaggacgtcgcacaccgcaatcccataccgttcgaaggtccgaacctgcaagggccccgccccgtccaccaccatcgcctccaagcgtttgatgatccgacgtagattcgaattaaccattgtcttccctccttgttatcttatctattttacccttctaactacttaaaggcaaaacggggcggtagcgctagcctaaaccactaccttaccccggttaattaaccagctaagggcgccgaacttagctcgctttccccaaggcgttggcgccaggtgctagcacctggcgccgcctaaaacaatctcatcaacaggatttgacaaagggccgatataaataagacccccacagccggccagcgactatgggggtctaagttaatctattttactaaggggagacggttccccttacttttcaacggctacttaacggcgccactcagttaatcattcatagggcttcaccggatcgggctttaagacgagggccaccatcccggcaaacatgccgaagtagtaggtgagaatccgccacaagagcatggccaagactagcttagcgttggaggtaatgaagctggcaaagaggacggtaaaggaatactcggcccccccagtccccccgggaatcgggaagagcgaggtaatcataaagatcaagacgtttaaggaaacgatcatcaccacgttaaggttttgcacccccagcgccaagagaatgaagtaaggaattaggtagtaaaaggccaactggactaaggtcaccaccgagaccttagcgagcttgccgtactcctgacgcatcttcaagctctcctggtaaaaggagtcaatccgctcgtctaagacccgctgccagttctggtaacggttctctttaacaaaccaacgcaccggccttaataagaggttggtggcccgcttggtaaaggagtgccagtacatgactaagagcaaggcgacgatcacgctcaggtgaatgacaaagccaaagaccaccagcaaggacagggcctggagcttggtggcaatgtagtgaaagccaatcagcatgctgataatgaagttaattacgatcatcccctgaaagacgacgaacttcatcaagaggaccgagctggcccggccgccatcgaccccagcctggagcatcgccactagttgggcgggttggcccccggtggaaaagggagtaatcccgttgaagagttgttcgaccagcggcacccgcatggtgtttttccagctaaagtccgggtaacggtcggccatgaagagcttggtaacgaccccttccagccccaggtaaaggcaaatacataagacggccacgctaaaccagccccagttgaggttggcgaggtcaatgcttaactgatgtaaatcggtgttgcgcaatgaaaaggcgaagatgccggcaccggcaacgagcatcaagatcaaaacgacccagttttttcgcgacatcctattccctccccgtttgcgttcgataaaagtggtaccactcattagccaggtggtccttggagtagcgttgggcggccgttagtgacttttgctttaggtcagctagggcgaccggatcctgggcaatccgcactagttctgcttgcatttggtcgacgtctttagccggttggtagtagccgccgatgattgagtggtacaaatcgaggtcgcgcaacatgaccggggtcccacacgaaaaggcttcaagtaccgacatcgggaagagctcgttataggaaggcaataaaaataggtcggcgatgttgtttaactcggcaatctggtcgcgggtaacgatccccgggaacaagaggttggccggcgggttagcgacaaccttcttgagctcttggtagccatcggtgatccggccaaaggaaaagcccccggcccagatgaattgaaagtgggggttttgtttggctagtttgatgaaatcaaagacgcccttccgttcttggatttgaccgctaccgacgaccgtgaagcgctcgggatccagtttccaccgccggtacagttcccaccgcttggccgccgagaccgggtaaaagcgctggtcatcgacaaaattggggatgtaggtcacccgttcttgtgggatcccgtaggccaccagcttggggataaaggtcgggttaaccacgaccaggtgatccatccgcttgtaaaaggcaatcaggtaacgataaaaaagcccccgaaacggttgggggatcttcaggctgccttccatcgtctcgggaaggaagtgcacgtagccgatcttttggccccgtttcttggaaaaggtcgacacaaaaaaacggggatcgatcgtgtggtagtggctgatgtcattttggcggctaaactcattaatttgaatatcgaactgggaagcaaagcggtcctttaacagggccatcagctccgcgtaggcgctcccgaccccctgccccgccaccttgtcagccgacgaatacatggtaattttaatcattttggttcctcaaatgacgaaaacgacgcccaaagcccggccgctttttttccgccacttcctcttggcagacccggtagaaatcaagcacccgctgcccaaacacctccgcggagatatcgtgcagtttctcgcggcgcttggcgattgcctccgggcttggcggggtggccaagtattccagtaccccgtcaaccaggtcggtgcgcttttgaaaggaacgcccaatcgccgggtcatcgattagctcgtccgtatactcggaacgcatgacgacaatcggcaagtcgctggccaaggcctcatcgtaagtcagcccctgggtttccgaatcgctagccgaaacgaagacgtcggccatttggtagtagtgacaaacctgatcgttatccacttggccggtaaaggatacgtggtcttgcaaccccatttcgcgcacctggcgctccagggttggccgcgccggcccctcccccacgattaaaagttgggcggcgggctctttttccaaaatgtccggcatggcttccacgagggcgtggatattcttttcaaaggccacccgcgacagcgacaagaggaccggcgtttgatcggtgtaaccaagcttttggcgcagggcgctgatctcttctttactatccggcgtttggaagacttgtaggttaaccccggttggaatcacccggatcggcgcttccaccccgtaggacaagagggtgtctaagacccgttcagacggggcgattaccccggtcatgttctttaagtaaaaatgagccaggtgggcaacgtctcgcggctttaagacccgcccgttagcgatgtagtggaggtagtcctggtacatggtgtggtaggtgtgtaggcacgggatcttcatttcccgggcgaccatcttccccatcatccccagcgaaaactcggtctggttgtggaccacgtctaagtcgagcttcttagctaaccgcaacaccttcagccacccgctaacggcaatccgccggtcggtaaaggagacaaagggaatgctagcaaagcggtaaattccctccgcctggtccgaaacgggatcagccgccgggtcggtggttgtaaaaatgtacacctggtggcccagcgcggttaattgatcgcgcagggtcttaatcgaggtggccaccccactcacctgggggaaatacgtatctgtaaacaaaccaatcttcaaagcttcggctcctttaattcttcgcaataaactacggttaattatactaaagggaattttcaggcgcaatttaggctattttagccccgttcctatccccggggcaagtcagatcataaacggggtgcccggctccttcggcccgacaccccgtttctattttttccagcttcctggtcgttggtaggcaggttaagctttccttaatatgttgattacttcatgtgactggttaattgatcgaccagcgccctgacttcggccgggctgtgggcagccagggcctggtgaatcagcggctgcagttgccgcaccttgaggcggcggatctgcgagcgaaccggcaggacctggcttagcgggaccgaaaactcatctaggcccatcgccgctaacaatggcacggcggtcggaatggtcgccatttcgccacacaacccgacccacttgccttccgcgtgggcacaatcaattgtctgcttaaccgcccgcaagacggccgggtgcagggactggtagaggctcgccacctgcccgttgccccggtcgacggcaaagaggtattggatcaaatcgttggtgccgatcgaaaagaagtcggcgtactgggccaactggtcggccatcgccacggcggccgggatttcaaccatcgccccgacctcatactccttgccgaccgggattccctcctgggtcagccggtttttctcctgatcgaccatccgctgggcctgctggaactcgtcaacggtcgccaccatcgggaacatgatcgctagctggccttacgccgaggcccgcaagagcgcccgcaactgggtccgaaatagccccgggtaggccaggctaacccgcaggccgcgcaggcccaagaaggggttgttctcccgttccaggggcacctgggcgagttgcttatcgccgccgatgtcgagcgtgcgcaccaccacccggtggttgttggcagccaagagcagcttccggtaggcctgaaactgggtttcttcgtccggtagggtatcttggtgtaagaaaagaaattcactacgaaagagaccgaccccctcggctccgctggtggccagttcgtcgctttcgcgtggcaaagcgacgttggcggccacttcaaagtggtgaccatcggcgctaacggtgtcttggtgctttaagacgcccagttcgcgcaggcgggcactctcccggctagccagccgttggtactgatcgatttgctgaggggtcggttgcaagatcacccgcccgtgggtaccgtcgatgatggcaaccatgtcgtcatcggcgtgttcggtcaccgtcttggtgtcgaccacggtgggaaagcgcatctccttgctcatcaccaagaagtgggcggtccggccacccaggtcggtcacaatcccggcgactaggtgtgggttcaagcgaatgatgtcggtcggcgtcagttggtgggcgacgatgatcgcccggtgatccaacttagccaggtccggcaattcttcatctaataggtgggccaagaggcgctttttgaagtcctgcagcgccagcccccgtgcgtggtagtaatccgccccgccggattggcgcttgaagacgtttaggtagtggtcaatccgctgggtcgccgtccaggccgccgtcgtcgagtagcgttggatggcgtcggtgatctccccttcaaaactttggtccttagcaattgctaattgggcgtcaatcacggtggcggccttctcccccatcttttggtgagcctgccgacgaaggtccgtcaattcacgtcttgctaacgaaaaagaatcatgaagccggctgacctcatgattcacattatcggtgtatttagctttaaccgtaaaccgcgattcacccaaccggtagaccggggcgatggcaatcccaccgccggcggccacgccgtcgagtacggtgaccattttagtcagtcaggccttccttagtcatggtttcggcaatggcttcgatggccttcgcttcgtcgtcaccttcggcagtgatggtaacgtcggcgttttggccaaccccgagggacataacccccatgatggacttcaggttaacgctcttgccgttgtaagcaagggaaatgtctgaagtgaacttggatgccgtttgaacgaggatcgttgcaggacgggcgtgaagcccagcttcggcagtaatcgtaaagtcgcgtttttccattataatcaatctccttagtgttgatttagcgttggcaaacataagacaccatctcatttggccaacactcactatttacctaattatagcgattgtaagcggtaaatacaaggcgaaccaccagaacttttagtcagttttgaagcggtagtgaatttgaccgccccgtccggcttgcccttcaatctggctgcgaaaggaactctcccggtaagcctgctgaaaggccataaagttatctggttcgacgagtagttcttcaatttttccgtcacgcaaatcggctaattgacgtacaaagtcttccttagttgccaagttgatgccccctcttatactgtggctagcactcattttagcattagttgccaatcagtgctaaaattttcggtaacgggagcccttacatgttcaatttttttatttgaaggggtgcaccctttcaattacggttgaaatgacttgcggtcccacgaaaagtaagtataatataggaaatggtcaagaaaagtcaaaggttgacccaaacgaagggggattaattgatgctctgtcaagtttgtcaacaaaaccaagccacgattcatctccaaatgatgatgaacgggcaaaaaatgcaaatcgacttatgtcaggattgctaccaaaaaatgcaaaacatgcaaatgaacctgttgaacgggggcagtgatatgaataatggattcggctttgggagtctggaagacttcatgaacgctatgaacaacatgcaaaaccaacaagccaataacaacaacgaaggccaacaagccagcctgaatcaaaaccaacgccaaggcggcggccgcggcaacggcaagggactgttagcccagttcgggattaacatgaccgagctggcccgccaaggcaagatcgacccggtgatcggccgcgataaggaaatcgcccgggtcgtcgaaatcttaaaccggcggaccaagaacaacccggttctgatcggggaagccggggttggtaagaccgccgttgtcgaagggctggcccaagccatcgtttccggtcaggtaccagaaaagctagctaataaggaagttattcgcttagacgtcgtctccctggtccaaggaaccggaatccgcggtcagtttgaacagcggatgcaacagttgatccaagaggtttctaaggacgaaaacgtgatcctcttcatcgacgaaatccacgaaattatgggtgccggcaacgccgagggcggcatggacgccggtaacgtcttgaagccggccctggcccggggtgagttccaactgatcggggccaccaccctcaacgaataccgcaagatcgaaaaggacgccgctttggcccggcggttccaaccggtcgaagttgaacaaccgtccgtcgacgaaacgatccagatcctaaacgggatcaagggccgctaccaggattaccaccacgttacctacactaacgacgccatcgaggcggccgctaagctatccgatcgctacatccaggaccgctccttgccggacaaggcgatcgacctcttggacgaagccggttcacgcaagaacctaaccttaaagaccgccgacccgcacactatcgaaaatgagattcacaccgccgaagcccacaagcaacaggccgttgaatcacaagactacgaaaaggccgccttctaccgcgaccaggtttataggttgaccaaggccaagaaggacgccgaggaaaaccacaccgaccaagccgccacggtcacggccgccgacatgcaaaagatcgtcgaagagatgaccaacatcccggtcagcgatctgcaaaagcaagagcaaaaccaactcaagaacctcgataagcagctcgaagaccacgtcatcggccaaaacgaagccgttgacaagatcgcccgcgccattcgccggaaccggattggtttaaacaagtccggccggccaatcggctccttcctcttcgtcgggccaaccggggttgggaagaccgaaaccgctaagcaactgtctaagctgctctttggttccaaggacgccatgatccgctttgacatgtccgaatacatggataagacctcaacttccaagttgattggggccgccccgggttacgtcggttacgaagaggccggccagttgaccgaacaagttcgccgccacccgtacagcctgatccttttggatgaggtggaaaaggcccacccagacgtcatgcacatgttcttacagatcctcgacgacggccgcttgaccgattcgcaagggcggacggtttcctttaaggacacgatcatcatcatgacctcgaacgccgggactggtgacatggtcgcctccgtcggctttggcgccgaggcggccggccaaaccaagtcggtcatctccaagctgaccaactacttcaagccggaattcttgaaccggttcgatgacatcgtggaattcaacgccctgaccaaggacgacttaatgaagattgtcggcctgatgatcgacgacgttaacaacatgttagccgaccgcaagctccacatcgaagtgccagacgccgttaaggaacgcttagttgacctcggttttgacccgaagatgggggcccggccactgcggcgggtcatccaagaacacatcgaagaccaaatcgccgattacgtcctcgaccacccggacgctaccaacctggtggcccaagtcgatgaagccggcaagatcaccgtggccgccacgccaaaggcgatcgccgcaccaatggacgccgccaccgacgctaagacggaagaataacgcaccaattgggtcccgctttgcctccaaaagtgggacctttttttatgctaaaatgaagcagggaaaaatctgtttgccccagcttcttatttcgtttttcgaatgtaagacaaaaaacgtggaaaataaccgcaggtctagtgcttaagcaggccgaagaacgatgcgtcccgcatcaaccgttcggctcagcttagtcatacgacctgccaaggaggttatttcccactctctgaagggaatgatttcgtgagcgacgaacaactcctcacccggccgctaatcacggtcaccaacctgatctggtcctttgacgccaccagccagacggtccagctcctcttggtccgccgcgaccaagaaccgtttgccgactcctgggccctgcccgaaaccttattacggcgccacgaaagcgctgatgacgccgcaatccgcctgatcaaggataagattggcctggagctgagcctggcggccaccgaacagttggccaccttcaccgcccccgaccgcgtccccggcgagcgggccctggccctggcttacatgacctttttaccctcgatgcccgctttgaccccgggctacggggccagcgaggtcgcttggtttaccctccggcggaccgccgagcaagacaccttgcaaaatgggcgccgcacctttattttaaatcgtccggcactggcctttgaccacgatcaaatcatcgccaccgccctgacccggatccaaaataagctcgattaccaaccgaccgtcttgaggatcctgggtcagcagttcaccttaaaggaggcccgcaacgtttacgccacctttttgaaaaccaccccggcggcgattgataattccaacttccgcaagacccacgcccacctgtttgaagagtgcggcaccgccacccccaagcaaagcggccgtccgcccaaaatatatcggctccggggctagccaagtacccggcaaaggagtaggattgactacaaggaataaaagtcattcctacttttatttttactcatgtttaggtattttttactttaatcacgcaacaccctcaccaaggaggttttcagcatgcagtcaccaactgcccttttgattatcgattacactaacgacttcgttgacgagcgtggcgccctgacctgtggccaaccggcccagcaaatcgccaccaccatcgttagcctggccgaccgggccctcaaagccggtcagtgggtcatcttgccgaccgacgtccaccagccacacgacccctaccacccggagagcaagctcttcccaccccacaaccaacgcaatacctgggggcgccagttctacggcccgcttaaggaatggtaccaagcccaccaggctaacgaccacgttgtgctgctcgataagacccgttactcagccttttgcggcacccgtctccaactcttcttgcaggagcgcggcatccgtcacctcgccctaaccggggtctgcaccgacatctgcatcctccacaccgccgtcgactcctacaaccggggctacaaactaacggtctaccaggatgccgttgccgccctgactcccaccggccaagaatgggcgctccaacattttcaaaccgttttaggcgccgaagtccttttggggggtgaaccaaatgaataaccacgccctgttaaccgacctctacgaattttcgatggccaacggttacctggccaccctgcccgatgatcgctgggcggtctttgacgtctttttccggaccgttcccgacgacggcagcttcgtgatcgccgccgggctggcccaggtcgtcgatcaactcaaggacctgcactttaccgccgctgacctggcctacatccagtcactgggcctctaccaaccagactttcttgactacctggcccacttccactttaccgggaccgtcagcgccatgccggaggggaccccggtctttgcccgcgaaccgctgttgactgtttgcgcccccctgatccagtgccagctgatcgaaacctggctgctcaacatcttaaaccaccagtccctgatcgccaccaaggcgcggcggatcgtggcggcagcggcgggccgtccggtgatggaattcggtgcccgccgtgcccagggtcccgacgccgctacctatggcgcccgggccgccgtgatcgggggctgcgctagcacctccaacgtcttggccggccagctcttccaactaccggtcgccggcacgatggcccacgcctgggtccagtcctttaacgacgaactgaccgcctttcggtcctgggccaaggtctacccggacagcgcctcgctgttggtcgacacctacgacgtcttaaagtccgggatccccaacgccatcacggtcttcaaggagctgcaagccgctggccaccagccggtcgggatccggattgactccggtgacatcgcccaacttgctacggccgcccgccaactgctcgaccaagccggcttcccgaacgctaagatcaccgcctccaattcgctagacgaaggcgtcatctcctccttgcttgaacaaggagcgcccttagataacttcggggttggcgacaagttgatcaccagcggttcggctccggtgctaagcggggtttataaaatggccgccctgaccgaaaacggccggtggcagcccaagatcaaactctccaactcacgggccaagatcaccctgccgggtaagaaacagacctaccgcctcttccacccccattccaaaaccgccttcgccgacgtgattaccctggccgacgaagaactcaccgccccgctaacggtcaccaacgtcgatccgctctccacattcagccaactcaccctaaccgactttgtggcccagccgctgcaagtcccggtggttagtaagggcgcccaaccggtggaaaccgacgtgctggcgatccaggaacgaacccagaaacaattagcccagttaccggccgccaccaagcgcttggtcaacccggacgcttacccggtctacctctcccctaagttggccgccttgcaacaggagttaatgaaggagcaccagcagtgagtgcgatccaacctcctcgataggccgtatggctaagctagggcgaacggttggtgcggtacgcaccgttctttgcccgtacttagacactaaccctgtggttgggagcacgttatcagtgagtgcggaccaaccattggcaagtcgtgggctaaggataggatacaggttagcgcgccagtggtgttctgtggccagacttagccactaggcctgcggttggggagcacgttatcagtaagtgcgacccaatcaatgggccaaactaggatccgacacaggacaaatgtttagatttgtgtaatacagtgagtgcggaccaaccattggtaggccgtgggctaaggatagggcgaacggttggtgcgccagcaccgttcttcggccagacttagccactaggcctgcggttggggagcacgttatgggaaagtgcggaccaacctcctcgacaaaccgtatgactaagctaggcctgtttgatagattgaggagcactcttttttgcgcccaattttagatttgtcgtgtctcccttggccaccacgctaactaaaaaagctggaaggaaatgaattccctccagcattttttatttattgatccttttttaacgcgtgcacgaccggcagggcgatcgccgggaccaccagggcggtgaccagcatttcaaccaggccgttagtggttaccaccgctagcagggcggtcgccaggttgctggtggtggcgtgataggcactcgccaccgccggggtgttagcgaacaggtaaataccgccgagcaccaaaacggtgttggtgaccgagcccattagcccggcaaagcaggccgccaaacttggtgagaccacctttttgaggccgataaagacccagccggccaccagcccgattaagagccggggcacaaacgaaatgagcgggttagtgaaaatcaacggtgctagcgggctggacgggtaaacaaaggcccgcacccaggtcaacaggccccagacaccgccgacaaccatcccttcccgcggcccccagacaacggccaccaccccgacggtaatcggtaaggtggtaatcgataagggaccgagcgggaggtttccaatcatcgggatcaggtcttgtaagacgatgatcacaatcagcagggcctgcgtggtcaagcgctgaatctgttgacgattttgcattccatttctcctctataccattctcagttaaataatctttaatattttaccacagttcctaactttgcgggctcttttccgggcgatcaggcgactttatgcgctttattgcggtatacttggtgaaaaacgaaaaactgatggggtgaaaaattatgggcgtaaattttcggaccggcaatccaatttgggtttactacaccgacgttgataccggtatcaacctgcgcgtgccaaccctcttaaagggcatggcgggcgaacagtatgtggtgcaccaattggacatcccgcgctataaattctttaaggcgactggtcctttgaccggcacctttgacgaccgccaaaagacggtccacttgtactaccggaagcaaacttggcacaagatcaaagacgtgaacctgtacttacaaacgatggccccgaccaccctcttcgaccaagtggacgggatgccggtggaatcacccatgccggccgggctctttttgcgggccttccagctaatcgaaaccaccaaccacgtcctctggtaccagattaacgccgaccgctgggttaaggagggcgaccatctgcgggtgttggcccacgacccttacgccgatgagccgtcgccggtccgggccaacctggagagcgacttcacctacctcaagttgaaccacctgccggcgacggtcgactttgtgcccaacggtaaggtcgccgtttacgaccaggcctacggaacggaaatcggccaggtggctgacggtcagaaactgatcctgactggtaaaattatggatgataacggggtcgtttggtacgagaccgtcgatcacggctacatcaacggttcctacttaaaactggaagaagattaaggagaagaagatgacagaaaaaatcgcaattgtcggcgtaggcgccatggggggcgcgatcgccaaggggctatataacactaaacaataccaattactggggttaaacccggttaacccgcgggtcactcagctggccgaggacctggagatgacggtggttaacgatccggccgccttggtcaacttagccccggacttggtgatcctcaccaccccggcgcccttgaccgtcgccaccgcccggtcgctggcgaacctaccaaccaccaccccggtggtttcggccgccgccgggattacccaagagcagctacaagcggtcctcggtgaccgcccgctggccaccatgatccccaacaccccggtcgccgttaacgccggggcgatcggcctcgccctaccgcaagagatggttgaaccggccggcaccctgattaaggaggtcttgggcagcctgggcacggcgattgaagttaaggaagcagaccttgacgtcgtgggcgtgatcggcggttgcggtccggcctttgtcgacgtgatgatggacgccctgtccgacggggcagtcaagcacgggctcaaccgccaagtcgcctaccaagtcatcgccgccatggtcgccgggaccgggaaactagccctggagaccggcctggccccggccctcttgcgcgaccaagtcgcctcgccgggtggcaccacgatccgcgggattgacgccctcgaacagcacggcttccgggccggcttgattgaggccgtcgaccaggcttccgggggccactatgtcgattaagcacccgcgcctggtcggtaacacgatcctctgggtcgtcgccgcgatctgggggagctcctacgtcttgatgaagatggtcactaacgcccagatgccggccggaatgatcaacggctggcggggcttgatcgccgccagcttcgtcggcctaatcttttttaaaaagttgcgtcacatgagcgcccacgacgttcacgtcggcatcgtcgccggaatcatcaactacatcgcctttcagtgtggcacgatcggcctcttttacaccaccccggccaacaacgcctttttaaccgccacctacgtcgccatggtccccttcctagcttggctgggccaccaacggccccgccgccaggacttctgggcggtcggcgtcgccatcattgggatggtgatcttaacccggttggtccagaccggattcgcccttcacttcggcgacctaatcgtcttagtggcggccttcttttacgccattcagatcctgtactacggcagtgcggccaccaaagtctcgccctgggtgatggtcttttgggtcagcttgttgcagggcattggcgggatgagctactcggtcttattcgagcgtagccagtggcccggcatcgaatggggaagggcgctgccaccgttactgactgtcgctttattagtgaccctgatgacccagctgttgcagatttacgcccagcgtttgaccagcgccacgaccgccgggatgatcatgatgaccgaatcgctgttttccagcctcttttcggtcctcttgggctttgaccggctgacctggtcgcttttgatcggcggcgggctcttggtcgtggccaacctgatctcgcaaattaacttttcccgcttcagccactgacggcgggctacccttcactagcaaagaatggtaaaatgtcccttgtgtcttacaaataattaacttagaggaggaaccatcgtggatgcaaaatttgttccactgattctggggagcgactttaacgcgtacggaatggcccgcgagctgtacaaggcttacggagtcaagtccgaagtttacgcccaggggagcctcgcaccaaccaagtattccaaaatcatcaatttccaccacgtcccggacttgatgaacgttagcacctttaccaagacgatcatcgatatcgccgatcaataccaagaaaaggggatcacccctttgttgatctcttgtggcgacgattacaccgagctagtggccaaaaaccgcaagcaactggtcgaccacatggtgacgccctacgccgactacgaaacggtcagcgacttaaccgacaaggaaaccttctacgaggcctgtgaaaagtacggactgccgtacccgaagacctcgattctaaagccggacaccgactggcaaaactaccagtcgccgtttggcttcccgatcgccctcaaggccgccgacgccgtcgagtggcataaggggaactttgaaggttacgaaaaggcctacatcattaacgaccaggcccgcttacacgaagttctcgagattatctaccaacacagcccttataagggcgacgtgattgtccaagaatacattcctggcgatgactccaacatgcgcacgatcaactgttacgttgaccagtaccaccaggtgaaactcatggcgctaggtaatcccttgttagaggattgcaacccgctcaacgtcggcaattacgtggcgatcttgcccgagtataacgagcaaatttaccacgacatcaagcagttcttagaacaagtcgacttcaccggctacgtcaacttcgacctcaagttcgaccaccgcgataacaagttcaaggtctttgacttgaacccgcgccagggccgcagctcctacttcgtttctttaaacggctacaacctgccgtcctacccggttgaagactacatcaccaagaccttaaaggataaggaaccggtgctggccttcaaggacgaaagcaagtaccaactgtggttaggggtttctaagcaaaccttcctcaagtacgcccgcgaaaacgaggccaaggaagtcgctaagcaactcttaaaggccggcaagtgggggacgaccttccactacgctgaggacatgaacctcaagcgctggatcatggaaaagcggatcaaccgctcctacgctaaaaacttcgccaagttcttcgtcgaaaagaaataagggccaacaagaggctgggaaaaaatctgtttttcccagcctcttatttttattcccgaatgttagacagaaaacgtggtaaataaccgcaggtctagtgtctaagtacggacgaagaacgatgcgtaccgcatcaaccattcgtcctagcttagccatacgacctgccgagtaggttatttcccactctctcaatcaacttccgattgacccccaccgggattttgcgtatcttagtcataagcaaagtatcttggtcatttaaggcgaaatgaccaagatactcggttaatggtgaagatattcatttacttagtagcgagttcgtcactcagccagttaaaatctgttagcgacccaatcacttcggtctcccccgcttcaaccgcttgtttagccgccaaggcttccggggaagccaagaatgaatcctgcttcttttctggttccaccagcagccctcctttcccttagtttcattttaacaaagcataagagcctgcgagaaaacacacttttctcgtaggctcttattgtctttttgaatgttagacagaagatgtggaacataaccgcagaccgttcgtcctagcttagtcatatcagccgacctgccgaggaggttatttcccactccctgtattaatcccgtcgcaactgcatgtgcaaggcgcacaggtagtcaatcccgaccatcaaggcgacccaaatcaggccgaggccgttccaaacaatcgggtggttaattgattggatcatcatgaccgcccgctcaggggtgaccagcaagaccaggcgcaccgccaaccagcagaggacgaagaaactggcgagcagggcaatcgttaggatgatcttccaccgcatgctcatcagcccgtagaggttccccagggccccggccgtcgtcaccccgatcagcatcgagatgatgatggcccactgctggctccaagtgacggtgccactttggagcaactcgatcagggcgttcatcaaccaggcgaccaccaggaccgtgatcaccatcaggtggtgggccagccagttcgtccagcgcgacaccccgttggcaattgcttctttaaagatctggtagggggtgcagatactgaagaaaacgagtaccaacaccatcatgtcgcttaaaaaggccagcatggaaactaagtttccaccatctatgctaatgctgcccgcctctacctcaatgtgaccactgaagaggattgctagcaagtagaagaccgccgagacaccgaggatactgataatggcgatcagggttagccagctgtagtggctcagctgctttaagtattgcttatttaacttttccatgttactccccccttagtggttagttagggcggtgaacgcccgctgcaggtctaagtgcttgatttgcacctggtcggggatcggacgcagggcgtctagctctccaatcacggccgtttccttcaggttgccgatcgtttggctgtcggtcgtggtttgcccggctgtgtattcgtccaccaactgggccggccccgataccaggaaggcccggcccaacagttcttccactggttcgttaacgatgatcttcccctcgtggaggatcaaaacgtcttccactagctgttgaacctcactgattaagtgggtcgataagacaaaggtccgcggcttttcgctgtaagtccgcaacagctcacggtaaaaggtttcccggtagttaacgtctaggcctaaggtaggttcatccaggagaacgtactgagcgttgacgtttagggcaattgtgatcttaacggccgtcttttgcccagttgagaggttggagaagcggtccttctcgttgatcccaaactgccccagcatccggcgggcgttagcgaagtcaaacttgccgtagaagcggtcagcatcggccaacattcttttcacccgggtcgtcttcgggtacatgttggattcgctcatcaggtaaatcttccccagctcctcgtcgttgttattaacgttttgcggtcccatcgccaccatcccgctggtggggaaaatccggttggtgatgatgtttaacagggtgctcttccccgccccgttccgtcccagcaggccgtaaatcttggccggtgccaggttgaaacttacttcatcgatcaccgtgtggcgccggtaacgcttggtgacgtggttaatcattagttcattgaccgtcatcttgatacccccgtttgattagttcctgtaagtgctcctctttgatgcccagcttcttggcttcggcgaccatcgccaccacgtaattgcggtagaagtcatcgcggtgcttggtggccagttgttcctgggcgcccggggtgacaaacatcccccgcccgcgccgcttttctaacaggcccaaggccaccagctgattcatacccttcaaaaccgtcgccgggttgatgttcaagctggcggacagttgggtggtcgatggcacctggtcgccagcctggtagacgccggtaaagatcatctccgccaattggttggcaatctgctggtacagcgggctgtcctgatcaaattcgaagttcatgggcccctcctttcggcaacttagttagttaattgcttgtgtaactaactatataaccaactaagttccctgtcaacaaaaaaaggccccttgtaagggacctttttgattaatgttgcaacgccctgacggtcttggttaaaccggcggcgaggctggtggatggccgccagcccaacgcccggcgtaacttggtatcatcgacggcgtagcggtgatcgtggccgagccgctcagccacgtgaaccacttgggaagcgggaaagccgagcaacgcttgcaggctggccacaacttctaacaccgtgcggcgttcaaagccgccaatgttatagacttcccccgccacgcccttgcgcattaccaagtcaatggcctggcaattatcgaccacgtacagccaatcgcggatgtcatcgccggtgccttgaatggtgagcggtcgctgctgacgggcattagtgatgatcatcggcaccagcttttccgggtgctgattgggcccgtagttattagcggaccgggtaatcacgacgtcctggccaaaggtgtggtgggccgccattgccaacaggtcggcggaagccttcgtcgccgcgtacggagaactcggctggaggggcgcttcttcatccgcccgccctgccgcaattgacccgtacacctcatcggtcgaaacctgcactaggcggacccgcgccctccggcaggcatccaagaggacctgcacccccactacgttcgtcgaaacaaagggcgccggatcttcaattgaacgatcgacgtgcgactcggccgcaaagttaaccaccacgtcaatttggtgcgtggtaagaacttcgctaacggtagcggcatcccggatatcaccctggataaagtggtagcggggggtagaagctaaatccgccacgttcgcaagattaccggcgtaggtcaggcaatcaaggttcaccacccggtcagttgggtagtgacttagctggtagcgcaagaagtggctaccgatgaagccggccccgccggtgactaaaatgttcataagtggggcctccttttgggctaagtctactgcttaatcttagaacgtaaacttcgaattagcattaacaacacaaacagccaaccgagcgatgaaacaatataaccgataatcataatcatagaaggcttaaagccaactacaatattgacctttttactttgagacgtaaattgaaccgttccacggctactcttttggtagttaacattcttaccattcacctgtaagtatgtgttccggtacgcaaccactggtaggttaatcttctttccctttacatcattgagactcatctcaagtttattggggcctgacttcttactaattttagtcttttgaccgtcaatatatgcgtaactatcaataatcgagcgtaacttggggttattgataacaatgccgtagtaagctgccgaatttcctccccatgattgtttagggaagtagtctgcttcaccgtacagaacaccatgtgaaaaaatctcactgtaagtttgattgttaaccttgtaagcaactggtgttccttgaggacctgattgttgaaccttaatggatatcgtatccaagctactgtccgttcgccaatccctcgtatgcaaaactgacaaaggataaaccgctgcaacaactagaacagcaaccattgcaactaattgttttcttttttctaatttcagtattgagctacctattgcctcagaagcaattagggccaaaaacagtcccgcatagcttaagtaacggtaaggaaactgaataacccctaaagctggaactatattttgaagcttttcccaagggaaaaaatcagttgtaacgagagccaatgtactccctaataaccagaccgtaattacgaaacgattgttaaagtaaatatatccggtaagtaatgcaattactagcacgaagcccaggttttgaccataactaccactaaaagagctgaaaataaagtcctttaactttaagatcatattaaagttaatctctgaatctgttgaggagatcttttgtccaatatagtcagacacaaatggacctaccatcatagcaactaaggatatagtcagtactacactcttcaaaagtgcttttattcgatcaatattagaccattttttggcaaagagtgaaatgataaatagaattgataagatttctatacataatagtgtacttaaaatatgacaataacttaccaatgctaacccaattgctaacagttgccaccggtgatcatcagcaaaaaataattcatatcctcctaaaataaccatcgggataaaggtcattgcaacgaattcaccaaacacaccagtaccgacaaacatatggtaaggcattaaagtgtataggagcgatgctaaaatcgccttgatactgctatttgacacttttttagcacaaagataagcaatcactaaggtacaaaaattgatcagtgcataccagccataaaaagcagttaccggactaaatataaagcggagcaatgcccaaggataaaggaaaatggttggataaaaaagaaaatttgcgacccctgttttttgaaaagtatgggttgcaatgtaagtaaataaatgcccatccttcaaattatcataaatttcttcgacccgagatacgtgaaaggaccagtcgttagcaataaataattggtgggaatgccataatgggtacgtcatagtaaacgtaacaaccaaaaatataaatatggcaacgaggtctgatctgtatttgtacttttctattttcttcattatccctgttcacctactaaaataaggtgcccccctttatatcttttatttatccgaatcaagcttaatgtattcaatcttcggccggaagaagatcccccgaattgaagcggagatcagaatccaaattttcttgagctttagtggtttgtgcgaaccaataacctttagaatgttccagttcaccttggcaaattggtagcaacgcccatataaaccatcctcgcgtgcaattacacattcgttccggtaagccaacttgtattgccatagccgggagccatcgtccttagcgatacttgaaccatcattgttcttagtgtggtgaacaacaatactttgcgccaccatataacacgggaactgcttggaaatccggttggagtactccatatcatcaccccaaatgaagaattccttgtaggaaagccccaccttttccactactgcggtccgcacgaagaaggaaacaaaggtcgcccgcgttgtccgtaaaatcccgttctttaagtattgggattcgtcaaaccacttcttgagtaccttttggccgttcatcttgcacggttgaccatcagtaaagagtacctcgctagctaagtacccgtagttaccacccaagatcttgtcagcctctaaaatcttttctagggcagttggggtcggcatggtatcgtcatccatcatccagacgtactggtagccccgcttgcaagcaacctttaaaccgtggttaaagccccctgacccaccgaggttagctcccgtgttgacgtaatcaattcgctcttcttgtaagaggtcatcaatgtattcccgggtgttatccgtgctggcgttatccaccaccagaatgtcaaagtcggtgacggtttggtctagtaaggcttgtagtgattgctttaacagaatcttgcggttataagtaaccacaatggcgcatatcttattcatcattcgctcctaattaactagttattgatcattttttccattgcgtgggtaatgtagtacccggtccgcatttggttagcaaccttttgaacgttatcgtgcatctgacggtactcttcttcggtcagggcgtctaacttatcgtttaagtcattaaggctactaatcgtaatcccaaccccgttttcaagcacaaaatcagccagagcggcctggtcccaaataatgaccggcagtcccgaactaaggtaaagagacgtcttgtgcgggttattccacttcaggtaacgaccaaagaccccatcacaggtgtcgacgctcgtcccgtgccaaaccaggccaaagttttcgtccatgtgggcaggtaagtccgttggtgaaaactgtcccttgtagttcaacccttcgttgtaactttccgccgggttcggtccaaagaggtcaaagcggttagttgggtgaacatcctgcaggaattctgcgtcaattaagttccccgcgtagcaaaccgacttatcgtagcccttgtattcctgaagtggttgcgggttatcgtaatcaaagatccccaggtcaactagcgggaccttcaccccttgttccttcaggaatttattcatcttagcattgtggccgatgatcccatccgaaaggttaaaggaatctaattccccttgggctcgctttggttcatccgcatacaagcgaatcatttcagcatcgtggatgatgaagtatagcttagcgtgactattttggtgcacactgtctgtaatttgtttgatcagcttattggagtacagcgggtattgaatcaccacattgtcaatgtccgggtgttccttgaagaactttggtaatacggagcgggatagttgatacttgtgaatgcgggtgttgatccagtcccacaagttgtggtgccaccagaagccgtccttccaaccataatcaagccataattccttaaagcccatctgttcctttaagaacttgatgttatccatatttgccttcgggcccccaacgttaccagaggggtccttcaatgaaatgatgtaattttccacgtttgcgttcctttcgcctatagcttcgacgttaattcaacatccgggtacttttgcttaaaccagttttccgcaaattgattttcaaacaagaagagcggttcgccctgcatgtccttgaccaagatgttgcgagaagatgacatcttcgggtccaattggtctgggttgatccagcgggccgtcttcttgcccattggttccatgatgacttcggaattgtattcgttttgcatccggaacttaaagacttcaaattgtagctgtcccacggcccctaaaatgtaatcgttggtgttgtaattttggtaaagctggactgccccttcttggaccaactgattgatccccttgtggaaggacttttgcttcatcacgttcttggccgagacccgaacaaagagttccggcgtaaactgcggcagcttttcaaacttaatgtcttccttaccagtgtaaatggaatccccaatttggaagttcccggtgtcgtaaaggccaataatatcaccggcaacggccttttccacgttttcccgggtgttagccatgaattcagtcacgttcgacagccggagtggcttcttcgtccgttccagggtaacgtccatcccgcggtcaaattcacctgagcaaacccggacaaaggcaatccggtcccggtgcttcgggttcatgttggcttgaatcttaaagacgaaaccggagaattccggggagagcgggtcaatcgccttcccttcttccgtcttgtgcgcactcggtgccggggcgtacttcaggtaggtttccaagaaggtcttgaccccgaagttagttagggctgaaccaaagaagactggggtttgatccccggccgccaccttttctgctgagaattcactgccggcttcagagatcaattccatcccttccaaggcgtcttcccattccccttcgccagccaacgggttctccccgatcacttccccgttttcatctaacggtaagtacggcttgctttcatcggccgggtgagttaaggccacccggtggttatggcgatcgtaaacccccatgaactgacggcccattccgattggccagtccatcgggtaagtttcaatcccgagggtttcttcgatctcattcatcaaatcgagtggttcccgcgcgtcccggtcgtacttattgatgaaagtaaaaatcgggatcccccgcatcttacaaatttggaagagcttgcgggtctggggttcgatccccttggccccgtcaatcaccatgaccgctgagtcaaccgccattaaagtccggtaggtatcttcagagaaatcttcgtgccccggggtatccaaaatgttgattcgcttgccatcgtaatcaaattgcatcacggaagaggtaacggagatcccccgcttttgttcgatttccatccagtcggacttggcaaagttcgagcttccccgccccttaaccgttcctgcttcccgaacgacgcccccaaagaggaggagctgttccgtaatcgtcgtcttcccggcgtcggggtgcgaaatgatcgcaaaggtccggcgcttacttactgcatcttctaattgttgtttagttgccaatcttgaattcctttcgttctctgttatggtgctccagttatcattcggtcagagccaatttagttttaaaacccacaactggtcgcgtttctgccactcgctttaagcgatggcgttctgcacactatcctttaaattttatcacatctcagctagctagattcaccctaatttaaagccctagcatccgttgtcacgcagaccctagggctttattattagtaaccgtttttatccttggccattttttcagtgtagtcttccgtttcgatattaaagcgtggccgatgcttaacttcggtaaagatcttccctacgtactcaccgattacactgactgaaattagctgaattccaccaagcaaccagattgagatcatcaaggatgcccaaccggttagagcatgacctaatattttttctactaaaacatagatcatcatgatgatgctaatcgaagtggtcaagatccctaagatcaaaattaattgaatcggggcaattgaaaaggaagaaatcccatcaaaagcaaagtgtaacatcttcccgagtgggtacttcgatttaccggcaaagcgctccttacggggatagtacaccttagccgaaggataccccactaacggaaccatcccccgtaaaaacaagttgcgctctttgtattgaagcagggcttccgttgcccgcttactgagcaagcggtagtcggcggaatctggaacgagattcacacccaagcgtttcattagcccataataggctagcgctgtccgccgtttaaagaaggaatccgtctcccggctattacgaaccccgtaaaccacatcaattccttctaagtacttatcaaccatctggtaaatggcgtttacgtcgtcttggaggtccgcatcgatggtgatgatcatatccgaatacttaactgctaccgtcattccggctaataaggcgttttggtgaccatagttacgggtaaacttaatccccgaaacgtaggagtacttctcgctatactcagagattaactcccaggtgcgatccttactcccgtcattgacaaagaggatcttactcttagtgctaatctttgcttgagcaatcaaatcttcgataattgtaccaatttctttaactgtttccgggagcacttcttcttcgttatagcacggtacgacaattgttaatgttttcaacataccatgcgcctccatcataattcagatttacccactacgctaaatcttccccatgaataccctagattataacaatgttatgtctaactagccgttagtttctcctcgtttcctcagattgtaaatacttattaagtaagttaccaccgtcttaacaactgcatagcacggaatacaaaggatcatccctggaatcccagcgatattccccgcagctaataagagcattatgatcgttaatgggtggatctgcagggttttgccaatgatattcgggtagataatgttaccgtcaatttgttgaacgatcacaaccactacaatcacccaaataatcttttctggcgccaccgcaatcgaaaccattaaggacggtgtaattccgatatagggtcccacatacgggatcatgttagcgatcccggctaccacgccgagaaccacagccaagggctggccaatgatcagatagccgatcgaagttgcgatcgccacgaacaggcactcaatggcttgcccagaaatgtaggatgagagtgtttgactcattttccttaatagctccccaacttcatcccggctattttccggaaagagtttttgtacgctcggtaccagtcggttaccatccttaaacatgtaaaaaagcattacgggaacggtaatggccacaatgaccgtactcgtaatcgtcccaatgattgttcccgcacttgaggttaaaccagtgacaatctggcgaacgtacttagaaacttgatcattaatttgactatagtaagtagataagtggagttttcgcacccacgggtgttccgagatctcttgaatcatcttctggctctccttggcagcctgggggagccaatgtatcacttggtttaactcattaagcaccgatggaattaacgccgaaatcccaccagccacaatcaagacgagcccgatcaccaccaccaagctcgcaatcccccgcttcatatgccatttgtaaaccttgatcttcattaataagcgaaagagtggttttaacatgtagtacaaaaagagcgagatgatcagcggggtgattaccacggaaacgaagaccagcaaaggggtaaagacaaagttaatctgggtgcagacccagattaaactcgcaataatcagtaattcaaacgaccaaaagagcgctttttgataactttttggcattatttcttttccttaatgatgtaaatcggtctgttcttaacttgcatgtagatacgaccgatgtatttcccgacaatcccaatgcagagcagctgtagtccccctagtaaaagaatgatgcaaaccatcgaggcccagccaaaggcactactcgttggctctatcagtcggcggatcaccacaaaaatcaacccaatgattgaaataataaaggaggtcgttcctagccaaactgctaatgataatggtgcctgtgagaagtcggcaattccgtccattgcatacttaaatagtttccaagttgaccaatcagtggttccggccacccgctcaacgtttttgtactctaaatacttggttttaaaaccgacccaggagaaaattcccttggaaaaacggctgtattccttcattgaaagaatggcatcgaccatttggcgggtcatcatccgaaagtcacgagctcctggaacgatattggtttgtgatacacggttaataactttataaaattggtcactgaggaaggattttatcttggcttctcccttccgatcggtccgccgagtccctacacaatcgtattcaccttcctggaggatggaatacatttggggaagaaaggacggcggatcttgcaagtccgcatccattaccaccacgtaatcaccggtagctgcttccagaccagcatagagggcactctccttcccaaagttccgggaaaaggttaggtaatgtacccgttcaggatcaatcgaatgcaactttcgcatttccgctaacgtttggtctgcagaaccgtcatctactaaccaatattccgtttttaaaccatctactctttggaccacctcttctacagctgggtaaaagagcgggagggcttcctgttcgttataacagggaacgacaattgataactttggcatttttaatcctcttaaatttaaataatgaaaaaccggcaccgcttagcagcaccggttttcattatacactatctaacaatgaactttgactagttctcagtaatggaagttggtgaaacattgtaagtgtaagtcttaccgtttaccgttccagtaaattgccagctgttcgttcccgtttgcgtagcggtaaaggaatcaacatcggtagctgatggttgaactggcattgattgacctgacgtcccagcattgttcaagttagctccgagacgttcctttaaaagatccaaggcttgggtctgagttaaagcagccgttgaggcacttgatgaagaactacttccgttagaagagctagaattcgaggcggttgcggctgccgcaccccgggaagcacttgacgaagacgttgatgagttagcagcggttgctgaactggaagatttactagatgaagaactggaatcatcagaaaccgtctttacttgttgcttcttcgtcgtggagttcttctttgaggccgccttactacttgcgcttacgctgtccgtagtatcactcccactcgcagatttattactgctgcaggccgctaatgaaagaagcatcgccccagcaacaattgaagttaatagcttgttagctttcataattttttcctctcaatatctcgaactctgattcttaatcacattataacaaagtctttgttcgatgattagtcataacttcacaattccctaatattttgaaaaagccccaggatatccctaaggctcctccttatatcaactagcttaagacgatgtagtagctaggtgtgaagtacttttggtaaccaatcttgacgttttcaccgaccgttggggcgtgaacgtaagaaccgtcacctaatgagatggccacgtggtacggagcggaatcactaccgaagaacagcaaggcaccctttggagcactagaaacgttggagtaaacgtgcgtcccaagcgtttgttgttggtaagtcgtccggtagctagaactcagaccatatgcccattgaactaaccccgagcagtcaaacccaacggaaggagagttaccaccccaaacgtatggtaccccgatttcgcctaaggccttgttgaccttggcattaacgtcattgaccaccgtaacaacaccattaccgtctgctttataggttgtgtttcccacagtaaatgtcttgttagttaccttcaagtgagttgaagaatcaaagtaataagttgatcccttccaactaacaagcccggactgaacaaccccgtcactaccaaccatgtaccaatctccccactgagagcgtacgtaatcttggtgatctaactttaagtaagtcgttgggtcaaagtaatagtacttaccataccacttttgaacaccggattgaacaatcccatcactgccgaccatgtaccaatctccccactgagaccgtacgtagtcttggtgatctaacttcaagtaagtagttggatcaaagtaatagtacttgccataccacttttgaacaccggatttaacgattccatcactgccgaccatgtaccaactcccccattgggactgaacgtaatcttggtgatctaatttcaggtagtttgtcgggttgaagtagtagtagcttccgtaccattgttggacacctgattggacaacaccatccttaaccaaataccaattgtgacccgttccgttaatcgtcggcaagtacgagtaactttcaccactagctaccttaccattagtgtagtaagtgtacgttccgttttcatttacccagccatttttagtagagctaacggctgcagcaacggcacggatctcggctgctgaagaagctgcactatcctgagtagaggttgcatctgacaagttactgtcattcatagagctagttgcacttacagttgcttcactagtcgtagttgcaacagatgacgacacagcagacgtggcactaatcgccgagctagcttcggttgccacagctgcggtactctgggtcacactagacgctgaactagttgcagatgaggcaactgcactaacactaacggattcagctgagaccggagcaacaaccgtttcagaactagctgcggatgcagtgctggaaacttccgtactgttaattgaagcaaccacaaccgttgcactcgtggcatcactttgtaccgctgaggaatcgttagtcgtttgtgaaacttccgtagtagcaatggcagatgaagcaacatccgcatttgccgttgcgttatcaaaagagacaaccccggcgatggcaactgcagcggtaatcgctagcgtcttccactgcttcccgctcttgtataacttgtagtgctttttactttccatcaacctaaatccttccgtagtttttggtttttagttaattatgtttaatttaaaagtttacgtttaataccatatcataaaaagttcatctttctacaatatttgatgatctgttaactaagaataacgtttgttacctttttgcaacattgtaagaaatctttgcaactaaaaaaccgccaaccaattgcttaattggcaatcagtcgacggaaagtttcgattttcgttacgttacagggaggttctatagcgtgttgtagtaaaggcttaccaactgacagaaattcgacatagtgtatgtcgttccaaaatacgtgcttgctcggttgtaccagtaaccatcgggattggtatggtcagtaccgcccaaatattgcgatacattatggtgcgaccataatgttcccgtcccattcgactgggccagtgacggaattagcccatactttttcatcatataggctgtaaagtatgccgcatttaaaatttccttcgtaaagttacttgctccggtaacctcaatttgttcaaattgaacggctcgtccatttgctggatatccagcccccccatgcttcgtgatcagtgcttgaaataacaataatattatttccatctacaaaggcatgaacaaaggcatcctcataagtattcttctcgtaattaatttcttcccaaatcgttgcatcatcggccgtctcatgaacaacaatcatgtttggttttccatctgaggtatcactataggtgtctgtaacatccgaagggattacgtaatcttatgtgattgcggcgtgacctagataattcttaagaatgtagctattaactgcattcgttactgccgtaagtttcccgtcactacccgcaatatatgcaacaccgtttgacacaacgtaaccactagtttttagtaagtaggttgttgggtcaaagtaataaagtgacccgtaccatctgataatcccagattgaacaattccatcactgccaaccatgtaccaactctactaccagtttgtgttacttctgtagctacaatcgtagctgaagttacatcagcattggccgttacatcattgaacgacaatactcctgcaatagccactacagcagtgattgccaatgtcttccattattttccactcttataaagcttatagtgttgctttttctcccccataattgatcctccctatctattttccaacttattgatttaattccttacttataattaggtaaattaaaatccccttaaggataacaaactattgtggcgcttgctacccctagggggattataagttaattagtttctatactccagctgccgtatcccatgattgcaacccataagttgtaatcacattattaaggctcgaagcatacgtcggtgaagttgcatatccatcagattgtaataacgaagttacagtagcgtagccagtttgatgtaacaagttactgtagcgactattgctatataagaagtatccgtggtcaacaacactttcatagaagcttgggtattttcggaattctgcatttacatagtagtaaccaccgctaccatattctgcagtcgacatgataacgtattgaccattatatgatcctttaatcccaaataagttgttggcttcagtagctaaggctgattgcccccaaccactttcaaggattgcttgagcagccgtcacggatggtaacacaccatattccttccaaccatcaagggttgcctggtaaatctttaataggaattgtgaagaagtcgtagtcccggtaataataccagtattatcggcagttaatgacattccattgtaactaaacgtcgtgttagttgcctttagatacgtcactgggttgaagtagtagtaatgaccataccattgaactaacccagattgaacgatcccatcactacctaccatgtaccagtccccccattgggacttaacataatcttggtggtccaactttaagtaggtcactggatcgaagtagtaatacttaccataccacttttgaacccctgattgaacgatcccatcactacctaccatgtaccagtccccccattgggacttaacataatcttggtggtccaactttaagtaggtcactggatcgaagtagtaatacttaccataccacttttgaacccctgattgaacgatcccatcactacctaccatgtaccaaagcccccattgggacttaacgtagtcttggtgatctaacttcaagtaagtagttggttcaaagtagtagtaacttccgtaccacttttgaacaccagatagcgctacaccatccttaactaggtaccagttgtagccagtcccactaattgatggtaaataggagtagttttcgccgctagcaacttccccattcgtgtagtatgtgtaggtaccgttctcactaacccaaccgtttttagttgagctcgtagctaccgctgccacttcacgcgtaactacttccgcagaagttacgctactatcttgagttaaagttgctgatgaatccgcactatcgcttgtagcactttcggttgattgacttgttaaagcagtagtagaagttgcaaccgaagacgaattgctaacagtccttgcttctgatgatgcagaagttacactcacttcagagcttgacgttgcactagttgcagcagtgtcagctgaacttacaaccgtacttgcgctagcagcgtctaccacggatgaagtagcgctagttacagaactggatgctaatgaagagacaacagcacttgaagccgcagcactagcttctgaagttgacgacgtagctacggctgaagtgctgctttccagtactactgaggaggcactgctagtttgtgctactgccacagttgcaaccgcagatgaggtaacatcggcatttacagttacattgttaagggaaaccaccccagctaccgcaaccgctgcagtaatggcgagtgtcttccattgttttccacttttatataacttatagtgctttttactttccatgaccttacctttttgttaaatatgttaattctttatcactgttatctactttaacactttatattcagcaaattttacttaaccccaagttgttaacaaacgataatatttgacatcttttggaaatattcattcttgcaaaaggttacggcaagatgtacttcatgagtttgaatttctttataagcaaaacgatcggtgccataacaagatagagaacaaacgggtatacgtatatatgaattgggttttgcaatacctcaaagtaactatcccatacctttggtgttacatggaatagataccagtcaaataactggataaacagcgggtgcaacacgtaaatccctagtgatgctgaagacaacaccgcaaagaacttcgtcaccctttctgatcgggcatgattggtaagtcgcttaattaaaatatataggccaaaggtatagaacatcgttcctaggttgttaaagtaaacaatcttattcacgaagatattatttaagatatcaattcctaagtttaaagtacctaaagcaatgatcgtcatctgaattttatccgatagataatcttccttaattagatagcccatcacatagtatgttatccacgacgaatttaatagaggcacattaatattgccgctactgagattaacacctttgagtgctgcaatataaggcaccacaatcccgcaagctactcctaccacgaccacataagcaagtatatctttatattttttcgctaacaccgcaaagactggggtggccaagtagagctgaatgatcgaaaagaagaaccagaacaaactattgatcttatcatccacaaatgattgaataaagtcacgtagggaaaaaacattccggtggaaaatccctgggaaagcataatagtggtagctataccaatagtagaaaaccgaccagattaaaaacggtaccacaaccctaaggaatctctttttaaaaaactctttcgtggattgacgatagcgataatctagcaacattgcaccagaattcataaaaaagatccccaccgcaggtaggaagatcgtttgcagaatatttccaatgattgtaatttgttcgtttggattcccctgatgggcgatctgggcagtatgttggactaaaacggcgaaaattgccatgcaattcagtatgtcgatataaagatagcgtttcttttccatattaaaccattactttcctaaaacttgttttgcttgctcaatcaccggcgccttaagaataaagaggcaggcaacataaataaccgtccccacaaagatctggatcgccatgttaacaatattcattgtcattacgtcacagattcggttaactacgaggaacattattagtccccctaagaagtaccgccaactacttctaaacaattggcgtcgccgaatggttgaacgaacaaaattcatctgtactgccatcacactgaactcggcaataacggttgctaacgccgctccgttggccgaataaaatgggatcaagaggatgttggcaatcacgttaaccaccgccccaattgaaacggaaaccgtgtactccttaacccggtcaattggcatcaagtattggtcaccagttacgttactccacgcaatgaagacaattgctggggcctcgaagaaaataatcttaccggcatcttggtacccattccctaagaaccacggggcgaatttttccgaaattgccattagaccaaacatcattggaactgccatcgccgttacaaagtcgaaggaattgtagaggctttcccgaacccccttcaaatcacccttagcaaacttattggcaatgtggggaagcataaccgtccccgtagccgttacgatcgctaagactagtttgaccaggcgatccgcatagtcaaactgccctaaggccgttggttgaccaatcttccctagcattaacttgttaaccaccaagtagatttgggtcgtaatcgttggaataaagaggagtaaggaggggtaaaagtgtcggaggggatgccattcttttggtgacacccactggatattggactttagatacggccatagggttaagtttccgcttaactgggcaaccccaatcaacaggatgtacttccaaagatcagcttccgtcttaaccagagtaaagatcaatacaatcgtgattaacttgacgattgtattccggacgaccgtctttttaaagtcctccatccccatgaagtaccaggaaacatcgatcccacaggcaacgatccaaagcgtttgaagaaggtagtattcccggaaggttgtcgaaaataagaacaccgccacgaggtaggcaactaaagagatgctaatcgtgcacagttgaagtgcttcaattccccaaaagattcgcgagcgttcccgcttatcatcccggtgataggcaacttctcggtttccgtataagccaatccccatttgaccgactaaataaaaaacagtgacccacccatttgtataagtgttgatcccactagcgtgtgcacccaaggcgcgggacacataaggggtcgtcactaagggggcaatcatcaaaagaatctgatagcccgcgttatacaaatagtttcggatcactttcatgcttacttattaaactccttttctacgcatacaagggccgcgtgcagtacttggtccatgtcatagtagcggtattggcccaaccggccaccaaagatcacattggcttccttttcttgggcaagcttagcatattgcttgtacaagtcattgttttgttggttgttgactgggtagtatggttcgtcaccgcggtgccagtcagctgggtattcccgggtcacgatcgtcttatccttgtcacccttaccaaactcaaagtgcttgtgttcaatcacccgggtgtatggcgtttccgcatcggtgtaattgataacggcgttcccttggtagttatcaacatccagttcttcggtttcaaaccgcaagctccggtattgaagttcccccagttggtagtcaaagaattcatcgatcattccggtgaagacgaccttcgggtagttagccaagtattcttcgcgcttggcaaagaagtccacgcccgtttccacatcaatcaaatcagaggctaacatcttttcaacgatttgtgtgtaaccaccaaccggaatcccttggaagtcatcgttgaagtagttgttatcgtaagtcaagcgaactggcaggcgacgaataatgaaggccggcaattcggttgccttttgcccccattgcttttccgtgtagcccttcaccagcttttcgtagatgtcacgaccaatcaatgagatggcttgttcttccaaattttgcggcgtcttaccggccatttcttggcgttgttcattaatcttgtccattgcctcttgcggcgtccgaacaccccacatcttgttgaaggtgttcatgttgaacggaaggttgtacatcgttcccttgtagttggctaccgggctgttagtataacggttaaaggttgcgaactggttaacgtaatcccagatttccttattggaagtgtggaaaatgtgggccccgtattggtgcacttggatcccatcaacttctttggtgaagatgtttccggcgatgtgatcacgcttttcaatcactttcacccgcttgccacgtttggcagcttcgtaagcaaaggtggcaccgaataaaccggccccaactacaagataatcgtacttagacattgtatattcctttcacacgtgtaattagtttaaacaatcatagcccaaattaagctttacaacaatatccattatgatccattagtagctaatctagagcttattaagtgttttttaaataaggtttcgccaagtcgtcacagtaaatgctaacaccatcccaacgattaacccaactgccacccctgctaataggtacttctttgttgaaggactagtttggctatcggcgtctttaaccttagccttggcaaaggttgaaattgttccggttgacggtgaaatctttggtaattcggtctttgcggcatcaacaacagcgttaactacttgcgttgcctccttggcattccccgcctctacagaaaccgtgagaactaagctttgcataacggtcttaaccttgatcatggataagatgtcttccgtactgtattgcttacgaagctttttcggcagttctttttgcgcagccgccgccacatcactactttcaatcatatccttgtacgtgttagtcaagcttaggtctgcttggacttgctcgttagccgtgctgttattataacggtgagcaaccattaaggaacggctcgcggtgtacgtagtgtgctttttggtgtgagcataaaagccaccagcggccccacccaaaactgcaaagatcaagattactaaaatgttcttccagaccactttagtaaggttactcagcgatattttcattgccatatttctttccccttatatttttcaaaacccattctaactgtggaatacttgcgagaataaagacgttgtaaatcaattggacggcgtgtggttcaaccatcgaattgatggcaactaacattacgattgccgatagggcgtactccttttgaaccgtgctaacaattgcgatgaaggtcatgatcacaataaagagcacgaagatgattaacccccataatagaagcatccgaacaaaggacgaatcgatataaaagtagtccgcactcaatccattttggttttggttagcaaaggtcttccccttcacaccaccaaatgatttttcgtggataaaacgtccaattaaatttggatcatacaaccggaaggcctttctactcaaacttagtcggccagacagcagctcgttgaatttccggtagatatgattactgtcatcaaagaagtaggcagccgtaatcgtgatcacagccaacaccggcattgccatccaccaaaaggaagcaatcatccttgagaatcttttcccttctgcagctcgttgcgtgacccacatcaccggaatcatcaacagcattgcatagaagtctagccgggtatcggtataaaccatcgcaattgttgcaacaaccgcaatcccaatgtaatcaaaccacttaagcttgccaaagcgaacgtagcaatatgctagtgccgagaaaaacaggtgggacgccacaaaggttgtataagccatcccaagcccatagcggttcggacgtagattagaaacatagactaagttaggaacaatattcaccaatgaagtggcggcaatcacaagtaatagagtcaccgataggtataagtaccacctagccacctgtttaaagtcaacgccacgcgcccctagcacgaaggccattgttaccattagttccggatactgggccgttcgccaagaaataatactagcaaccaataatgctgttattactaatttaccggacacttgccattcatccatcacgtaaattttaaaaattagcaacgggatgacgaggtaagtaattaagcgtaactcggaccaactcagcaaggttgtataggttgaatcaattaagaaggcggggacaaagtatagactgaaggccagtaagtaaacatgctgcccctgaatcggtgcccgccaaatttcagctattcttgctttcattcttcaattcctatgcgtgtcccgtgatcttacgttggataaacttaccaccctttttcaaccagttggtatgctccataaagacgtagttaacttctttggtcttgtactctgggtggacctccaaccatacgtccaagagtagctcgctcaagaatccgtagacccgctgttcgtaggttgagtagttagagatatcagtttgggcttccactttagctaaaacgtcgtacatccaagtgcagtactcattgaggggctttttcttcataatgaacatgttaaacatgtgtgcccaagtccgcttcatcactagctcaaaggctggtgcatactctgggtattgctcttgtatcacctggcgcatcacctcaaatggttcgtggtggtgagcatgtaagtaatgcgattcgttagtctcgatgtagtacttccgcttagatggcaggataatatcgtagtcttctaatagcgccacggtttctttttccgacagcaccgtttgaagcgacttatggtgacgtagactcaggtaacggcggtagtgcaccaaccccatggcatctacgtctaagttcttccaaccccagtaaatggcggttagctcgttataagtcgggttcttttgggaaatgttatcgcccgtgttatccccttggaaggtgtggttaacatctgggtgtaggtccttacccacaaaaaccggcagatacattggatctgtcggcatctcgtaatttttgtgggcggcaactaatacttttactcgcacaatgttctcctttagtaggctccgtttggtttgatcattactttcacggtttcaagcatgatctttaaatccaaccacacggagcgattttgaatgtaggttaggtcgaggcggaccatttcgtcaaagtccacgtcgtttcggccccccacttgccacattccggtggccccaggggtcactaagaggcgttgcttatcgtactccgtgtactgctccacctccgaaaccagtggcggccggggcccaacgatgctcattgatccggtcaccacgttaattaactgtggcaactcatccaagctgtacttacgaatcacacggccaacccgggtgatccgggggtcgtccttcattttaaacatcgccccatcaacctcgttttgatcttgtaatttggcgaggagctcatctgcgttactaaccattgagcggaacttgatgattttgaattcgtgtccgtccttccccacccgggtttgggtgtaaaacaccggcccgtggggatcatcaactttgatgcaaattgcaatgattaacagtaccggactgatgaccaccaccccgattgccgaggccaccacgtcaaacagacgcttgatcccccggtaaaagtattggcggtttaatcgttccgcatcaatgtgaatcatgttttcaaccattagcgtttctctcgatttcaaattaacttgggctctctagtcgccccatttttcacttcattgttgataaccgcaacccattgtaaatagattctatttacaaatactcctctaatgataccaataaattagggcgttaaaaagaacttttcgtccggaacccctttcatcagttattaaggttttcttgcttggccagccactgatcaatttcatcgaggtcaaaccccttgcggtaaagggcctgcttagtcttcatctttcgttcataaccttcaaaccggcggtaacggtgccaagctttttccgcttcccgttccagtaattccgcctggcgatcctccgtttgggacgggatttcgttttccttcaccagttggtaaacttcatcgccgtacccttgggttagcaccccctggtggattttttcgcttcggcgccgtgccggttggttcaggtaacgcttggccagcttttgcaccagtttggcggcattttcaacctgttgttccgtggtgaactgggtaagggcgtcgtcaattaaaaactcgcccacccgcttttgacgaagtttttggcgaatcacccccggtcccttcaaaccagtattcatctccgtccgcacgtaagcagccgcgtactcccggtcatccaacaagcggttttcccgcaacttggccatcaccaccgggacaaactccggtggggtgtcaatctccactagcttttgttccacctcgtgttcggtccgcagttggtgggacaagtaatccagcatcttattataggcttgcgccacttggtcatcatttgagatctgctgcagtaattcctgatcgacctccatccccttataaagacggtatttgatcaagacactctcggccactggaaaggcgtactggccgtttaaaaagacgttaaagcgccccggtcgtttttgggccacaatggcggtaatttgtcgaatttgcgattctttttccatgatccacccttacaaattttcgcttggtttctatgtataaggtgtaagcagtgatcacaacttacaccaatcaaatttaaaggagatatcaacatgcttcataacgtcaaatccactaagcttcaagttaccttaatcgatggcgatcaccccgaaggtttgaaccgggtctttaacaacctggttgcccaaccgagtgatgagcagatcgccagcttccaaaccatccttgaaggattagccgggggtaccgtccaagaagccaccctgacgaccgccacgactttaactaacgaatagccataaccactagccaaccgaaaggaagtacttaaatgaagaccttaaacctcacctacaagggtagcctaaacaagacgcacatcttgaagatcaactacgccaatggccaactggacgaagcaaccgttcgccaagccatgacccagatcgccaacctaaagctgtttaagaagggcgaagaagatctgttcgtcacgcccgtttccgctaaggtggtcaacaccgacgaagaagtactctttgcttaattgctaacgaccagaggctgggagaaaaccgtgttttctcccagccttttgctgtattcacgaaagttaggcaggaaatgtggaaaataaccgcaggtctagtgcctaagtacggccgaagaacagtgcatactgcactaaccgttcgtcctagcttagtcatacgacctgccgagtaggttatttcccacccacttttttgattcgttcatgaacccactgccaaaagtaggggcgttggctaactggtccatccaccagcacctggcaggtagcgttgacaatcgccccgatcatcacaatcatcccggaaaagtccaaccacatcatcatcaaaatgaaggccccgattgtcttgtaggaatttaaccgttgggcgaatacgacggcgtaataggagaagaggcgcgataggcccatccacagcaaggtggcaaccagggcgccaattaccacgtaccgcaggcgcacccgggcgttaggaacgaagtaatagagcagggttaagaagataaagagcccgccaaaggtcactggccaccgtaggctactaaagagggtgacgtaattaattgggaagtgcaagattggctgtaaggcttctagcacctgttccccgagcccatacataatcactaaggcaaagataatcatgatgacgatgatcatccaaataaaggacaggacccggttaatgatcggattttggttcttagccaccccgtaggcaccgttgacggagcgttgaaaggccgcaattccttggctagttgaccacagggccaccaaggccccggtagtcaggatccccccactcccccggcgtaagaaatcaaaaatgatcggccggataaattggtagaccgaactagggattgccgattgcagatacgggaggaccgtttttgcatctaaccccagcatcggtaagaggtttcccaccactagcaccgccgggaaaatggaaagtaaggtatagtaggccagcacggccgccgaagttgttacttgcgccatttggaagtgttcggcaaagaccgtcacaaagcacttcaatttggtgccaataaatttcatcatggccctcccacacgttaataggcccattttagcagtttctaacggcgaaaacaaaaagaactcccgtgaggaactcttttgtctttctagctgtgcattatttcttgacgattccgctcactttcctacttcatcatatgcaactggtacaggtactgcttaccggccgtcaaatcgtattgaaccagcttgtaatcttgccagagtcgtttttgcttcttagttaactggctgtacttaaccacttgccccttactgtttgtgaactggaggctagcagtactattgttttgaccagtgttaatggaaacggctggtaagtcctcatatacctttgtcatcaaagcaaggtatggcgtgaccttggaattagtttgttccgctaccatcgccatgaagtcattcgggctaactaccttagtgttactggtcaaagtccgggcactgtgttcacgggcgtaggtgttggagtagatgaagtaatccgtttcatgcagcttggtcccatcctttgccatgctgttgttgtaaatccccggcagatggtcaccatagaagacaactgtgattggcttttggatcttgttaatctgcttgatgaactgcttaactgctttgtcggtgtaggtaagccccgttgtatacgttgcaaccgtccccttatctgtcccttcacttaccgaagttgggagccacttggagtagtttttatggtactgagtatcataaggcatatggttttgcatcgtgaccaagttgataaaggtaccatttttatcagtcttcagttgcgtcaaagcattcgcataagacgtttcatcagacagatatgggcttttaccgatctttttcttatctataattttgtacttacttcccagatagtaaaaacggttgaagccaaatttagcataatccgcgacccgactgtagaacaccccttggtacgggtgaattccaacggcatagtcaaacaattgattaaaggtccagtttttcgttaaacgtggtacgatctgggtatatggggtttgcaatgttgacgagaagttagccgttgccaatcccgttaaggtcatgtattccatgttggccgttcccccaccgtaacctgaggacatcatcaggccactggtggtcgttttcttcaaggaaagaatatatggaatcgggtttcccttgatcttaactcccggcacccgcttggggttagagaagctttcactcaggttaaacatgattgtttgcgatgatagcgaatttttccgatctttgtttatctcctctgccaccacttgatattctcgggcaatcttttccatccgggctttcgaatagccggctggcttttccatcacagtgatgtcgatattattcaggaactggatgatgggtccattttctcgtgctccgtcttgttggttgtaaaaaattggatgatcccctagcccctcaataactgtactaatccttgagtcggtgtggttccaaaagatgctacttccaaagaaaaggacggtgagcacagtccaaatacaacgtctttttgtacttggggcgggaacaggtaattttcgatctaggtaaatccctagtccaattgtaattacgtagacaactgcacctgtgatcggaatccatgcactcactaatttaagcatgtttccgtatgcttgatacatcatcacatctgacggaaggatcggctcttccctagttatcaacttaatccgattagcaatcccccatattatgataagggggaccacaatcgatagtgctagccaatacctcttcaccagtgattgaactagcttgaaaactagccaaattaataaggccgtaaaaagcagtatcccctggcgagcagttaaaaggtagatatagttatcaaaggtcattgaaccagctggatttactttccaacttgtaaacatcaacaggttcgaaattaccgccaacccatacgctaccccgaccgccgtcaaggctggccagtgacgatggcaaaacttcttcagccacgctggccactccatcaagtgggacggcagctcctcaacccaccgctcgtaatgttgggtgatcgctaaagatgaaaagagccttcttaagcaccaattagccacgaatccgaccaccataacggcacccgcaatgatcgctaccaaaaggatcttcaagcccagattaccgacgtggccagcggcaaagccaacataatggctccgcaataaaggcagtcctgccaaaacaaggctactgtagatccctccgtttaaaatttggtgctcaccgataacctggttcttctgtaagagaaacatccccagtgtcaccagcaccaataagccatctgataggttagagaaacggtttgccgttgacatatcatagtgaatcgttactgaaattgtcggcattaacattgccaacaccgccgttaccagcagggttaccgttccccaacgtttcacaaaccggcgccagtggtccggcagttcgatcccatcaaaggcggcgccgaccatcatcaccattaggtaaaagaggacgttttggctgtctttgatcccccacaaatcgttgtaaaagaccgtcgcaaccagaaacatccccactagtacttttccgaggaagcgtcggttaacttcggacagttcgttaacccgcggaaaggtcgccatggcgataatgtaggccgttgccagcggaaagatattccgggtgattgggaaaacggcgtttaaaaggtcgctgaagtaaaactggttcttccaaactagttgaaggaggactgaaccggccccataggccaccaggactaaccaggtggtgacgacgcgggtgcggccaagccggtgtcgcttcaaagttcgcccaagttgcattaacaaccacagctcggcaataatcaaaatcacgtggactaactggagaaccgccatcttgaggttgttttccgagtaattactaaactgaagttgtgaatcccacatccagaggttcatcaccgtcaagagaagggcgattagccaaccagagttcgctattatttttttcatgttactacctttataaaaagtggggttgaaagaaaataaccgtttcttccaacccctaattctattttattgtcccctagataacgtggaaaacctccgtagccccaccacctaaggccggcctacattgaagagtggttttcccccccaattatctattcttcgtacttcttggccacccgccgtgcaatctcgccgtagtgggccaattccttggcgtactcatcatcgtacaggtacttggcgtccgcttccggatcttgggaggtcaggatctttggcccgtcctccgtaattaccagggtgtgctcgtattggcacgaccagccaccgtcggccgtcttagccagccagccagacggatcggaggtgtcggcttgccaagtgccggtgttaatcatcggttccaccgtgatcgtcatccccttgcgtaggcgtaggccgtggccggcttccccgtagtgaggtaccattgggtcttcgtgcatcgtgggtccgattccgtggccaacaaattccttgacgtccccgtagccattttcgtcttcggtgtagtgctgaattacggcaccaatgtcaccaatccggttgcccggtacgcactggtcaatccccatgtacaaggacttcttagtgacgtccatcagtttggcaatctccggtgacggggtgcccacggcgtacgaccagcaagaatcggaaaaggcgccgtcgaggttgaccaccgtgtcaaccttaaccagatcgccatcctttaagatcaacttcttgcgcggaaaaccgtgacaaatttcatcgttaacactcacacaggttgcgtacttgtacccttcaaagccaatttgagcggcgatcgcccccgcttgcttgaagtaatcacgggcaaattcttcgattacccagctcgaaatgcccggccggataatcttttgaatccccaggtgcatcccggctaaaacggcgccggacttttccatcgcacggatttcccgtggtgattttaagctaatcattcacactactccttacattttataaactcttaccagtatagcactctttgaatgtgctatactatcgaaggttttaaaattacaaatcgttcaaacctttggagggataatcatggcaaaagcactcgtggtttacgccaccattaccggaaacaatgaggacgtcgccgacatggtcaccggcgccctggaggacctcggcgttgacgttgaaatgaccgaaatgacgatggccgacgtcgccgatttcgatgacgtcgacctttgcgtggtgtgcccctacacctacgacgaaggctccctgcctgacgaagggctcgacttctttgatgacttaaaggaagccaacttagctggaaaagtctacggggtcgctggttccggtgacaccttctacggtgatgattactgcaaggccgttgacgaatttggcgccgcctttgaacaagcgggtgccaccaaggggagcgaaaacgtccacatcaacctcgccccagatgccgaagacgaggaacgcttggccagctttgccaaggacctcgtggccaagctaggctaggaggccgtcatgcgcaaactctggaacaagtacggtcaagtgatcgcctacctcttttggggtgtggtcaccaccctggtcaacatcgtgtcgttccagttcctctcctcaggggtccactggaactaccaggtggccaatgtaacggcctggtttttatccgtcttagttgcctacctcaccaacaaggtctgggtttttaactcccattacaccacttggaaggccttttggattgagatctcccagttcttcttttaccggggtctcaccctcttgatcgacatggccttcatgttcgtaggggtgaccctgttgaagctcaacaccccaattcaagaactaatggtgaagatcgtcgataacgtggtggtcgtggtcaccaactacattttctcgcggtggctgatctttaaggacaacgaaaaaattgctaagcggtagtagtcgctaaccaaataaactccggtcagtccgcgaaatgcgaattgaccggagttttcttttgaggaagtctttccaaatgtcatagggatcatataacaaacaagagttcttggttttatgctgaagttcccgtataattgaaaggcaggaagttataagggcggtggctgtcttttcctggtgaggtgaggtctatggaaacatggaagaatcttcagaagggtttcacagctaatgagtgtctttcaggcacttacgtcgatgctgatgtttggcacgtttgtactaacgttgctagattacatcaaaaagcatcacaaatagaaaaagccgtcccacattataactttggacgagttatgggacgactttagattctcgtaacaacgccatcgcctttctagcgacctgcgtcggagtcctgttggcgcagggctcctttttgtatcttcattatagcacgaaataccaaattgggagaattagttgcctttgtttacggctaacctattgctcttatggtcccacccggaatcgaaccgggatcaatcgcttaggaggcggacgtactatccaattatactatgggaccaacacaagaaaaattatcgcattctttaccggacttgtaaaggtgcgatcatcttcttgttacttttgttgctcttcgtttttgcgccggtgcttcaagcgaatccccttgttcttgcggttcttctttttgtgcttggccttggcaggctggctgaaggaatctagcgtgcgtaccacttcttttttcgggttgcccttggcgtcgtgttgacgcttttgcaccgccttgacggtcgccttttcaaccgacttccccgcgttcttagcgtcctcgccggaaaccaactggcgcttgtcgatcgtcatcggctccaactggtagtcggtgtcggccaaaagcttcttgaggtcgcggaagtcgtggtcgtccccaaggttgaccaccaggcccggttccccctggcgcccggtccggcccgtccggtgaacgtagccatccgccgtattcggcagctcgaagttaaccaccgccgggagcttaggaatgtccaggccccgggccgccacgtctgtcgttaacaagagcttaacttggtgtttgcggaactggcgcatcaccgtttcccgttcggtttggcgctgccgcccgcccaaagtggctgatgaaatgccgtcgtggcgcaagcggctggcggtgtagtggagagtcttaatgctagtgaaaaagaccagcgcccggaagttcttggtttgactgagccgttccagcatcaccgctttgtcactcatcgtccgggccaccaccaacccgtgcttaaccgggccgcgggagtgatcctgggcccgcacatcaatcttgaccaggtcgcggccaaacaagacgtcgagctgttccaaggtcgttgattgggtggcggagaaaaaggccaactgggtgtctagtggcgttgcccgctcaatgtcttcgaccaccgcttgggtgtcgtcgcgcaagaggtcgtcggcttcgtcgatcaccaatgtggctaagttgtttaacttgaggtcacgggtgtctagcaggtgtaagatccgacccggcgtccccacgacgacttcagggcgctcctttttcaaccgttccgtttggcggcgcaggttagcgcccccggtcgcggagtggaccttaagccccagtaaggccgcccattcccgcatcacccgggtggtttgcagagccaattcctgtgacggttcgaggaccaggatttgggttccctgccccttcatcaccttgggtaacagcggccaggtgaaggccagggtcttccccgagccggtcggggcgatcccaaagacggtcttgtcctcttctaagggcttttggaccgcctcttgaatggcggtcagttgtttgaagttgcgttcttcaaagtgggtttgaaactgttcaatcaaatcaatcatcctctagcggttgttgtcagctgggaaagtgagctccgccgattcacgcaggttgtacatgacggcgttcacttcccggcttagggtttgccaacgcttgtagttggccacttgttctgggtcgtccggagcgttaaacagagcggcgaagtcgtttaattcatcgaccatcgagttttcaaagtacggcgcctccagttccgttggttcctggttggcatcgaagtaggtcaccttggtggtgtcaaagatcgaatcaaagaccagggtgtcctttaggccgtagatttcagaaaccaggtgggagttagcggtcttaccgaagttcagggtcactgcaaactgatcgtaagttaagatggccgtccccattccgtcaacgccagacttggtcatggttgggaagtaaacgacgctgtccggcacgccaaacagggtcaccgccccataaacggcgtaaaccccgaggtccatcaaagcccccccggcaaattccggcgtgaagatgttcgggtacggcttctcgtcggctaggaccttgtcgtagcgcgaagagtacttcatcacggtgatgttagccccttggatcgtgtccatcttctttaattggtcttcaccagcgtggaagaggccggtgtgaatgtggcgcgcggcttcgaccaggcgggccttggggtgggcggccagcaacgattcaatccggctgaattcttccgggttgacgaaggctggcttttctaggatcacaaacttatcgttttcgatcgccaggcgggcctgttcgtagtgcttgctgtttggtgaggcgatgtaaaccacgtcaaagtcgccttcatcaaagaagtcctccagcgagtcgtagaaggcagtggcgccgtacggttccccgtattccttggcccgggtcagggtccgggagtagaccgccgtcaattggtattgaccagtcgtcttagcggcgtctaacatttgatcggtgataatgttggttccaataattccaagcttgagcatcgtaaattctccttttttctcatgttactactattttaacaacttcccctggtttttaacagaaatgaaatcttttctcatcaacattctgtgtataatatatgttgtttaaagccgatgctatcgaatgataaggcaagtttataaagtggggagtatgtaaaatgcggaaaaagggaatgttactgttcggcgcgggactaatggctggaatcactagttcgcttggtttcagccactcaaaaaagaaaaacgaacgttcaacctccttaccgatcttttacgccggcacctggcgctattacgatgaggagcgggaccggacccacgtcattaccatctcacctgaactcgaattggggatcgataaccaggtgattccggccaacgttcaacacgttagcaccgatcaacttgtctacctcgataaatttggttaccacatcacgatcaaggccaacgagcagcggcccacccgcctgatcgatgaagcggacgaccaagaataccaaatcgaaccagtgcaataacataaaagccacccgtcccaagcgggtggcttttatgttaacaggcccttgttgtataatggtcacatctgatttgcggaaaggaagaacaggatgttaaaacgattagcagtgtattgcggcgcccgcgctgggcaggacccttcctttatggaaatggcaactgactttggccaccagatggccgaacacgacgtcgccctagtttacggtggcggtcgcttcggtctcatgggggcggtggccgacgccgtcttggaagccggtggccaggcccacggggtgattaccgaagaattggccgaccggggcactagccacccggacctgaccagcctagaaatcgttgacgacatgaatacccgcaagaaccacatgatggaaatggcggacggcttactcgccctccccggtggtctgggaaccctagaagaagttagcgaggccttttcctggaccgccctgggcgataacgctaaaccggtcgccctctacaactaccgcaacttctaccaacccctaaaggacatgctggccacgatggagatgaccggctttaccgaaccgccctacgtcaacgcaattaagttcgccaccaactttgatgaggtcgccgacttcatgaatcattaccaggctccggcgatccgtacttacgaataactagccctgcatggccgtcaactgcgtcttaatcgcggtggcggccacttttagttgggcctcttcaaccgggtacaagcggggcaaccagaactggcccacccccgcccgggtaatttgggccgggaaggacatgtagcactgatactgcggctgatagaccgcaactggcagcacggtgctcccgttttgtaataaaacatccaggatcgctaacgtccacgagcacagagtgtaactgcccttgtcgaccgtcgtcaacacccggtactcctcttctcgaacgtccaccaagagcttggcggtatccagggaatggccgttaatcggctcctcaatcgaccgcccgttgacccggacgctcgaccagattggcaccaggttgccgtcgtgctggcccagcatgtaaccgattaccgagctggtcggttgctccaccgccgccgccaccacctggtgcaagcgggccgtatcggtaatcgtaccggtccccagtacccgctggaccggtaactgccactcttgttggatcaaaccggtcaaggcttcgttaggcgtcgccaagttcaagaccaccccgctaaagccactttcggtaacggcggagcgccattcctgaattgcttggacgttgccggccagttgcgcaaacgaatccggttggcccaagaaacgctgcccaatcgtcaccaccaagacgtcagcggccttgagggcggccggatcttggatcaccacttcacagtggggcgccgggctggcagccaggtcagcggccaggcccaccgcaatttgatcatcttggtccaataataccaggcggtcgacccggttggtggccgctaacagccgcgccagggtgactcctaaattagttaagccaattacggcaatggttcgcatgatgattcctccaattaaaaagcgtggccaatgaccttctcggcaggccggatgactaagctaggcctgcggtgattggccacgtcttctatactaagatttaaaactaataataaggggctgggaacccctgctcccagcccctatttgattggtcactttctttattcgttacccacttccgggaagaggtttagcaggtattgttgcggtccctcttctaggggcaggtccacgtccgccggcagtagttcctcgtggtcgcccacgttgaagcggaccccgtggtctaaccacacttggatccccagcacgattgccgcccggatcaattcctgggcggtcaccgagtaccccttggcgatcacggctaacggttggctggattgcaccagctccaagtaacggtcgttggccaccttcaggccaaaggaaagcatcgtgccgttttccatcttggaagccatctgtccggcaatcgttaagctcgggtcttcaatccggcgttgaacaaacttcagggccaaccggtatttgcgcggggcgtcgtactcctcgcagaaggcttccagctggttgacgaaatcaagcccctcttctttcatccagtcctcctgggcggttggttcttggagggcggcctgctcgtttcgttcggtggcgacccttaccttgtcggccatgtcgtccgtcgtttccgtcaggagggtgtagatcatgaccagttcgaggaagtttaaggtatcctctgagatcccggccttggagaatggatcggtgtcaaagccgcgcatcgagatgtattggaccccatcgttgatcgtcttttccaagttgctggtccgcccgtgtaagcagaccggcccaaagtactcgtggaagctttggtaggtgccgttttcaaggtagtcggccaagctgttgatgtaggcatctaaagagctgtaatcgacctgttcgtttggcaagttggtgaagccgtacttggagttacgcaaagaccggacctggtgttctaactccggcgccacgatgtctttgacgctggtcgccaccgggctggccccaaacaggtaagtaaagagccattgccaacggtaaaagccctgggcaagcttaaagtaaaggtggttttggaaatcagcttggcgccggtacttatcctggtagaagcggtggtagatttcctctaagagctgcttgtccaggccgtaaccgacgtgaactccccccatcaacagcgacttaatgccgtacttgccgactaggtagtggtaaaaatccttttggtcagggcgcgagcagttataactcaaaaaatcaaggtcgtacttgtagaccagggccgggggcatcgttaacggccacaagcgttcctggctttccatctggcggtcaacgatctgctgaaggatttgcagctggcggacggccgcctcgctccccttcacaatcacggcgttgaattccatcaaattatcagaaatcccgctcgttaggtaggggtttttcacccgtgaacccagttgactcgggtaagggtaacggctcgcccgaccgtcagttaacacacgatgggcttgcatccgcatcccaaagcttcccgcaaataacttcgcccgtaattctggctcatgcattgcttctcgcattgccgcacatcgatccatcattgtcacctcacaaggcccgggggcccttttcaattaatttttcctcaaggagttcattatagcacttgtttttgaacgggcgacaccgttttcacgattaatcacgcaccgcccctacttaaacttgtgttgcataacggtcaaaatatgcaaaatgaccgacaggatggcaaagaaaatcaccacgaacaccgtccaggacagccagaaggtggctgcaacggctaagaaactgaagagccaggtttggagccccatcgtaatcagggtcaccaaggcaattgtaaagaataaaactatgtatctgaacacggttaaggtccacctctcttttacgtgcgggttggtaatttcttgacccagcttagttagctccgccaccttggcctgggggagtcccttcatcttccaggtccccgtttgcaccgcttcgcccaccttaacgaggccggcatcgagcagcaccttatcgacctgttccaggggtgggttggaggcccgaaagataaagtttttgattgggccggcgtaacacgaagtcagcgatacgtaacgcttgccggcaaatttcccgggaaataaccgtccggtgtggtcctcgcggtaaaagcggcgccggaaacagtcaaagaagtttttcaattgtccactcatgttccctagataagtgggtgatgagatgatccacacgtcagccgccagcagtttcttttctaactcccgcaacaccgggttggggtgccccggataatccggtccaatctggtaatccgccaggtagatggtctccacttcccacgccggatccattgttaacccggcggttgtcgtcaccaacatctgtccggaaataccggtttgtttatgtgacgctaagattgctaacgctcgcatcgatctgccacccctttttttcaattggggttattatagcaaattccgcactaagttgaaattgagccattcatttggcgcccgctggtaaatatgctatcctagggttaatttgaaaccgaatacaaaggagatttcgatatggcagtttctaagattagcatctcccccgaagcaagtaagtggttccgtgaggtcatgggcgttcccgaaggtggcggggtccacttcttcggccgggtttacggtgaaaccaacgcccacaaagggttctcaaccgggatgagccggcacgaccaaccagttcagccactggtcgaccaagtcgttgacggtgttcactactacatcgaagaatcagaaaactggttttttgaaggcctcgacgtccaagtcgactacgacaagtccatcgacggccctgtttattactacacccctaacgacggctctaagctagacacccacgcccactcttccaagacggaaccgtaaggagtgagtgtgaaccagcccacttggcaggccgttgggctaagctagggcgaacggttggtgtggtacgcaccgttcttcgcccgtacttaggcactaggcctgcggctggtgagcacgttatcagagtgagtgtgaacctacctacttccccacgcttagccttttaggttataatggaaataccaaaggagccctgctgataacaggactccagcgcaggtcgctaaaaaggcactggcgttgttatatgtgacataaagtcgtcctataactgctcaaagttattttgtaggacggctttttctatttgtgatgcttcttgatgtaatccaacaacgttattacaaacgtgccgaacatcagcatcagggttagcgcctgaaagacgcgcagtacaacaaaagggctccagtagttcgctttacgaacccaactggagccctttattttacgggaaacatcaagaccaaggtttccccttttatagctgatactaaaacaccccctgggaacgtcgcgttcctgggggggttagtttattattcgtacagggcggccacttgtttttgggccgtcgggtgggccaaaaagtcatcgtaagtggtgtcggcgcggctcacaaagccgtttggtcccacttcaatcaggtggtcagcaatcgtttgaatgaattcgtggtcgtggctggtgaagaggatcgagcctgggaagctttccatggcgtcgtttagcgccgtgatcgattccaggtcgaggtggttggtcgggtcgtccatcaataagacgttggcgtgttgcaacatcatcttggataagaggcaccgcaccttttcgcccccggaaaggaccttgatttgcttgtcaatttcttccccggagaacagcatcttccctaagaagccgcgcaggaaggtattgtcgttttcctctttggtggcgaattggcgcaaccagtcaatgatcgtcaattcatcgttatcaaaggcggcgtttaagtcacgggacatgtagttagtagaggtcgtttggccccaggtaacggtcccttcgtccggcgttatttccccggcaataatttgcatcaagacggtcgtcgccatgtcgttgcgggacaagaaggccaccttttcgcccggccggatcaagaaggagacgtcgtttaacaacttttcgccgtcaacggtgtgggaaatgtgttccacctttaataggtcgtttcccagcgggcggtcctgttcaaacttgatgtaggggtacttacgcattgacggttggatgtcttctaaggtgatcttttccaactgcttcttacgggaagtggcctgcttgtgcttggaggcgttggccgagaagcgggcgatgaactcttggagctccttgatcttttcttccttcttagcgttttggttggcggctaattgggcagccagttggctagattcgtaccagaagtcgtagttccccacgtagagcttgatcttttggaagtctacgtcacacatctgggtgcagacttggtttaagaagtgacggtcgtgggagacgacgatcacgatcttatcgtagccggccaggaagtcttccagccaggcgatcgtgtgaacgtccagcccgttggtcggttcgtctagcaagaggatgtctggcgagtcgaacagggcttgggccaagagcaccttcaccttgtcgctttcggccagttcacccatcaaggtgtcgtgtaggctttccggaatccccagtgattggaggagttgggaggcgttggcttcggcgttccagccgtccatttcggcaaattcggcttctagttcggccaccttcaccccgtcttcatcggagaagtccggcttggcgtagagggcgtctttttcttgcatgatttggtacagcttggcgtggccctgaatcacggtgtccatgaccgtgcagtcgtcaaaggcgaagtggtcctggtttaaggaggtcatccgttcgttagggccaatcgaaatcgtcccggtcgtcgggctcatcttcccttccaacagctttaagaaggtggacttgccggccccgttcgccccaatcaccccgtagcagttaccaggcgtgaacttgaggttaacgtcgcggtacaaggtccggcctgacaggttcaggctcaggtcagtaatggtaatcacgtgcaatttcctcgtgttttctaaaattttgctctcaccaatttagcacgaactaacgcttccgggcaagcctccctactcaatcaaaacgggcgtcatcaaaacttaatcttcataaaataagcaacgcccaccacttggcgagcgttgcttagattgtgcgctgtgtttagaggtcccgttccggagccttccccagttccgcttggatcatccaaagccgcttttcggtcgcggtcttgaaaccaatgaagatgtcctgggtggagaagtccttttcatcgtcactaatttcgatcccctgctggtagagatcggctaagtaacggtagtccttggctagcacttcgaaccgttcgggcgttgacttgttccagttgcctggttcgtcgggaatcttggtgtgttccgccatttccttaagggtggagtatggtgaaccatcaagggcgatcagccgttcggaaatttcgtctagttggtcgttcaaatcgtccatccagtcgtccatcagcgggtggagcttcaagaagttttccccgcgcatgtaccagtgggtttggtgaaccaccatcaccagttggctcaggtcagcaacgagttggttgagtacttccttggtcttttcgtatttcatgaattaaacctccctttacgtaaataaggtaacacaatttaaaaccgctttcaaatgttttgcttaaacgcgcaacgcccctagtctaggcgtttaattttaccggcggcaatcggtaaggtaacgtgttgttcgtacttgtcgttaagcttacccgccacggtcgccggcaattctaattccgccggtaccccgtggacgtagacgacccgcttatcaagggccagtgcttggtcgtggaagacctccttgaacttagcctctagcttagccaacgggacgtccttttcgtaactgtagtagcccgttgcgtcggccaccgggtagttatcgttgggaatgttcatctcgtggggagcggcatccagtggcaccatcgtcgtcccagagacgggctcggtttccggtaggtcaatgtagccatcgtggttaacgtcttgggcctcagttggaatactggcgtccttgccatccgggaaaccatggaagtgctcccagtgctggatgttagcgggggtatcaaacatctccaacttaatgtggagattatcgccttcggtggtgaattctacgtagccgtgcgcctcagtcccaattttggcggcgttgagcggcttaatttccgcacggtatttagtcatcaaaattcctccaatccaattttaagtgttcccaatctgggatcattgtagcgcttgcggcccaaaagtgaattgataaggatcaaggataagcaaaagcggtggaaagaaacgaaccagactgcggaggggagacaggacaaatgtttggatttgtgcaataaagtgagtgcgaccaacctcctcgacaggccgttgggctaagctagggcgggggttagtgcggtacgcactgttctctgcccgtacttagccactaagcctgtggttgggagcacgttatctggaaatgcgaccaacctcctcgacaagccgttgggtcgcacttccattttgcgtaaatttgcagatttgtcctgtcctatttgccgctttgtcctcaaactggaagtggctcccgaccttcccaacggtagagaaaaaagcatcaaaaaagaggcggtgacacattgttcactgccccttaatttcactaataaacgaacgctgagcccgtggtccccgtcccgtaggagctagtcccgtatgaactagtgccataagagctggtgccgtagctagagctggtcgaagaagaactggtgccgctgcccgggctattgtaagaagccccgtttggtagaacaaagttaacgttggtgtaaccatcgtaagtcgtttgctcgttgtacatccttgtttcggcgttggtaacggtcttggtcttcaagcctaattgggtccgaattaacttagaaatccggttaatttcctttggcgtggcgatttggaaggaaaccccttcgatcgtcgcatccaggtcttgcatgtggtaggtcttaacgttatccatggcggcgtggtagttggtgtacaaagcagccacgttgtcaatcggaatgtcggtcttcaccccgtccccgacggcctttaagatgtcgttggccgcggtgatgctcccggacttcttaaaggtcttgatgacggattccatcacttgttgctggcgtttttgccggccgtagtccccgtttggatcgtcgtaacgcatccgggagtacttcagggcgttggccccgttcaagtgttgcttccccttcttaaagtggtgcccttcataagtgaaggcgaacgggttgtcgacggtgaccccaccaacggcgttaaccaccttttccaagacccccatgttgatcacggcgtagtaatcaatcggtacgccgagtaattccttaacctgcttgacggtttgcttggccccgccgatttggtaggcggcgttgatcttaacgtaatcggccccttcgtcggtgttcaccttgatcagggtatcacgcggaatcgaggtcattgtaatcgtcttcttcttggggttaatcgtgatcaattccagggtatcggtgttcccaccggtattcccccggtttaaggcccccacgtcggtccccatcgctaaaattgagatcggcttaccggcctttaacttcgctgagatcttcccgctcccgctagagaagacatccttagcggtgctattgatttggtggtattcataggcccccccggccacaattaacaagaggatcaagaagatgatccgcttcacccacttaaaccacttcttactgccccggtagtatggcgggtggggattgcgcccgttgccaccggttccggcgccgttcgtaccagactcgggttggttgtttacccggcgccggtagtcggcacgcgtttcgttttcttcgttcataactacaatacctcaacagtgatataacatttttactaacgttaccactttatcagaaccatctaattgtggtcaatttgccccggtgattttaataaatccgtaaggtctttacttatttttcaccagtcaaaaggcgagctgacgggcgttcagcgaacggacgtcgactacgggattaaaaaaggggcgcacccattcgcagatgcatcccagattcttctaattttggtcaccgtggattttatctaacaggtcaccaaaggtttgcttttcttccgccgtcaggttcttaaagagcccctcaaacatcgtcttttgggcgtcttccacttcggcggcccgtgccttacccaggtcggttaagaagagcagggttgcccgcttatccttcgggtcaacctcgcgctttaggtagccgtcgtcttctaacttgctaaccagctcggaagtcgaggattggttgataccaaagccctcggccagttccttttgccgaatgccgtcagggtgcttaccgattaacactaagaggtgttcgcgactgtgaccatgccccagccccggcttggcaaatggcggcatgtggtgcctccccatcatcatgcccgggcccatgccgtcgtgcattgggcagccctggccgtttggtccgtgttcgtggtggtggcacttgccccccattgggccggagccgtggacccgtttgtgcaggcccttcaccgtcttcatcagcttatgcattaactcttggtcgttgatttccgtcatgttacttcatcccttcgtattaggttgattttaatttaattcggtaccgatgattttagaataaccccagcgaagcgagaagtcaatttatttcgtctccgaagtaatttacactttaggaccccgctctcggtactggcggggagtcaccccggtccagcgcttaaagcactggctgaaaaattcaatcgaggaagagaattgaccatgttatcaaaatacgtatacggcctttcgctgggccactttgtcgttgactttagccagggggcgttggccgccctgttacccctcttaattgcccaacaccacttcaactacgccattgccgccaccctggtctttgccatgaacctggtttcttcaattattcaaccgctgtttggctttttatccgaccgtttccgtacaggttggataattatcccggcccttttaatcaccggtctgggcttcgggacgctcggttgggataaccaatacttcctcttgattaccagctgcttagtctgcggggtcggaatcgccgcctaccaccccgacgccgccaagttggttaacggtttggccgatgttaatcagggccacgccatgagcgttttctcctttggtggtaacctgggctttgcctacgggccgatcacggtcactttggtcgctaacgccctggggatttccggggttggcctctttatcctggtgggcggcggagtagccttattgttagcgcactacttccccgccatgcgtcggtaatcagcccaacactggtaacaaaagcggcaacgagaaagtggctccccggttccggttaaagacgactggcgccacttcgccattttagcttgcgttttattcgggcgttcaattattttttacgggtttaacaccttcttggtcctctactggatgcacattctcaagcagtccaacaccagcgggagtttagccctcagcgttctctttatcgtgggggcgaccggaacgatcatcggcggtcacttggtcgaccacattagcgccgtcaaaacgattcggttcgcctttaccatcatgcccttcttgttgctggcctttagcttaaccaagagcgttatcgttgccagcgccctcctcttgccgatcgggatgttaattttcatcccttacagctcgattgtcctgctgggccagcgctacttgcctaaccagatgggcttggcttccggggttaccctcggcctggccatcagcatcggtgggattgccaccccctttttgggccaggttgctgatgccacgagcctaatcaccgtcttcttcatcctgacggcggttgccctcatcccaatgggggccgcatatttcattatcgaaccaaccattaagtaagctataatttaggtaaaaaggaggcgcccctatgcaaactacctgccattaccaatcccctttaggtgacattttactggtcagcgacgaacaaggggtgtgcggcctctggtttgaagacggccgctactatgccgatacggttgaagacgacgcccaagcaggaaccagcccggcactagaccaggcccgccgctggcttgacgaatattttgccggccaagccccgacttggctaccgcccctccacgttcagggaacccccttccaacgacaggtttgggaacggttactgacgatcccctacggccacctgttaacttacggcgagctagctaaacgggtggcgaagcttcgccaccggacctccatgtccgcccaggcggtcggcaacgccgtcggtaaaaaccacctctccttgttcatcccctgccaccgggtcatcgggacgcacggtaacttgaccggttacggaggtagcttagaacgtaaaatcgccctacttgaattagaagggcatttggcaagtgacttttcttggccatcctaatttcccgggaaattttttgaacaaacagggggcgccccacctttatttatcttataattaaagtaattcattgcgaagggagcccgtaccgtgttattgatccaccaagccattaacgccattggggaactggtcctcgccctgaccatcccctttttgtggtggttaattgtcacccggcgccaagtccgcttcgaccgttggttgggcttttccctcccgccggtccaacgcacctggctgacgaccgtcatcgttgtcttgttcacccttttgctggcgatccccctccccctgattgtcgaccacgggatcttggccaccttcgttttcaaccaccggggcttcgccggcatcccggctgcgctggtgtacgcgatcgtggggacctctttgcccgaggagatctttttccggggcttcttactcaagcgcctccaggaccgcttcggctttttgcccgccaacctcacccaggcaatttgcttcggggcggtccacggcctcttgctggcgggcgccgggaactggctggtcaccctgatcatcgtcctaatcgaaatggtgattggctactgtctgggctggctcaacgaacgccgtagtggcggttcgctgtacaccagctgggggatccacgccctcttaaacaccgtttccgctttgattgccttattcacctaattgaggagtgatttttttgcaaaccgcgaacctgttaatcgccaccctgctcttgatcgccggtatcatcgtcatctacctgggggtcttcgctaaggaaatcgaacacccaaccggcactaaccgccttttccaacgcctcagcgggctgggaattaaggcttcgatgcggccggccctgatcgtgaccggcgtcgtcttagttgggacgtccctatacatttttggtggcatttaaaaaggaccgggagaaccattttttctcccgatcctttttatttgcttgccgttaacacccgcgtcaccatcaccccgtagaccccatcgaggccggcgttggtaacttcaatttcctgggcgcctagcgtggccagcgcccgccggtattcaccgctgtgttcaatgtcgatgatcgctaaccggccgccgggcttgagaacccgcagcgcctcggtcaatgcctggcgccgcgcttgcttgggcttgacgttgtggagcgacaggctagcaaaaacggcgtcgaattggttgtcattaaagggtaacgccatcatgtcggcggtttgcagttgcgcaacctggctaaccccggccgcttcaattaccgcttgggtggccgcctggcggttgccagattggtcgaccctcttccagatgtcgatcccggttaccttgccgggcgcccttaagtgcttagccacggctagcatcacggcgccgtgaccacagccgaggtctaaaacctgatccgtagcggcgatccgggttttacccaccacccggtcaatgatcttgtatttgccaaccagcgaggtgcgcagatacaggtaggtacaagcgaaaaatacgagcgccaacgggacggtggtccaagtgtgacccgccattcccgccactaattctaaaatcccggccagccctaacaaaatggggaccagcggggcgtcaacggtacgtttcatcattatttcctccgggaacttgttttgctaattataccaatttcccgggaaataaaccgacccccagccaaatttgctgagggtcggttttaattttcaactgttggcctagcttagccaaacggtctatcgaggaggttagtcgcacttctcataacgctcttcctacttaatgaccccaaagccgccggtccagccgatttgttcactggcggccaaggtcatttgcaagaagccagttgcttccagttcacgggcccgcttgagcttgccggcatcgagtacggccaagggactgccctttaaagcctccttgaaggtcgccttggcgtcatcatcgtcaccggccaccaggacggtcgtttgttgttggccgccaacttggccgctttgcagagtagcggcgaaggtcgtgttaaaggcctttaagaccttgctgtttggcaggcgcttttgcagttcctgggcagccgagctgtcggcgggaaccactaattcgtcccaggtctcaaagttgagcgggttggtgatgtccacgaccaccttaccggccaattggtcaccgtattggtcggctaagtctgccaacgccgggtacggtaccgccatgatcaccaggtcccccaagctaaaaatgtcatcattggaacctacgtaggtgactgtgttaccggccagttcgaagttgtggccaatggcttgccccatgttacccttaccaaaaattgtaattttcatgattaagcttcctttttgttttcgtgttctgcgatgttagcaagtgtctcgtcgaccagttgttgaaccgtaatttggtccaggcgctgttcaatcccgacttgaacctcagcaaagtgcttggtaatcacctccggaaaggcgaccccgacgctacactggcccgaggtttcttgatccggcaccaagaaggggttcttgggcgcggtggcccggtaaacgtccaacaccgtgatctgatcaaggtcacgggcaaagttatcgtagcggttgttttgccgggccgctaaaatatcggcggcccgtagttgggcaatcatcttgcgcacctgactcgggttggtttttaaactcgaggcgagaatctggctagatacctcttctccttggtggacctttaggtaaacgaggatctgcagtagatcactaacgcgggtattggcgatcgtgtccccctcctttctcttttctctttcaacttggccttaggataacacttactttttggaagtgcaacttttttagtaacactaattcaaataaaaaaagcggtggggtcacccgaccgctttttcgctaattaagggctacatgtgcatccccatcttcttgtaggagtccatcccgccaagccagagttcatccatcgtgacgccccgctccttggcaaaggcctccatcagggtcatatggttgagcaagtggtactcccggtccggggcggccgggtcgacaacctttagttgggccatcatcccgccatcttcgtgttcgataatgtgacaatggtacataaagacccccggcacttggaagtagaccttgatgatgacgtgttcgcccgggttaacggcgacggtgtcgttaagtccgtgttcaaacgggtagggttcctggccgttacgggagacgatctcaaaggcgcagccgtgcatgtggaaggggtgaatcatcccgccgttcatgtcgttggtgttggtaatgtcccaaagctggcacttgcccatcggcatcgtgtaatcgatccggtccatctggaacttcttgccgtcaatcatcaccgtctcgtccatcccggacatcaccacctgcttgacgggtaggctcgggtctggggtcgggtaatcaatcttggtcagggtggtgggcaactcctctcctgccggcgtaaactcgtggatccggaactcgaccagcggactgtcgtcggagtacagggtaaccgtgtcgcccggctggtagccggcaaagtcgaccacgatctcctggcgctcggcacaggtagtcatcagcttctttaacttgaccgggtggggcaaaaagctcaggtccgagccaatttgggtgaaggttaagtcgtccgagaagtggagccggtactcgcggcggttagagccgtttaaaattcgcaaccgcaggcgctgggtggtgacgtcaaagtaaggattgacggtggcgttaatcaccgccgtgtcaccctggacgccatcagggtcgtaatcggcccgttaatcaaactggttgcccgcgtggaagttgcggtcctgcaagatcaacggcaggtcatcaactccgtaagtgtgcggcaggggcaaactagcttcttcttggtcgtgaatgatcgccatcgtcgccagtccctgccaaacctggtaggccgtttccgggcaggggtgggcgtggagccaggcggtggcggccggctgaatgatcttaaaggtcacgtcgcgggcctcgcccgggtaaaccggggcgtggcagccgccgtcttcaattggcccgggaatctctagtccgtgccagtggaaggtcgtcacttccggtaggtggttgaccaggtgcatgtggtaagtcttgccgcgctcaaagaccaccgtctgccccagcattgaagcgttaaagccccaggtcttggtcttttcccccggcaatagctgggttgcccccgcctgggcggtaacggtgtagtacacgtcgtcgccgtccaccttgtctggggttaacaggggcggaatgttgaggggcgtcgcgggtgcttgagcctgcttcagtggcttgtaggccgcatcgtgaaggttgaaggcttgctcatcgtaaaagtaggaatcgaaaactggttcattcatcaaaatcaccctcctttccttcattataaatttttaaataacgaattgaaagggtgcacccctttaatcagcatttctaatcggaatgtggactagcttcacctggttgccgtggtcggccaacagctgcaccaaatcgctggcctttagccacaccgtcgccgtgttaacgttggggtgggccgccaccaatcccgcagccaattcctggtcaatcatcacctcaaccttgcgctgctcatcatttaaaacccccagcggcgtcaccgagcccggtgtcaagtcgaggtacttttgtaagtcttgctcggaggcgaaactcaaccgccgggtcccctcctgggcacttaaggcctttaagtcgacccgcttttcccctttgaccgtgactaggtagtaatggcggtgcttgtcatcgcggacaaagaggtttttagcgttggcctcggggtggggcatcggaaagtcggccaccgccgccatatcaaagaccgccgggtggttggtcacctcgtagtcgatcccgtgctcagttaggtattgatacacttctgcttggttcatcagcatcctcctttactacaataattgtgataaaattaaaattagattaagttgattataatcgaagaaggaggaatcgcaatgctcttttctaacgcccttgtccgcacccccggccactcggtgatcgacgggatcgatgactacgccaacctggggcaaaccgactaccccaccgccctcgctcagcaccaagcctacgttgccctgttaaaggaccgcggggtgaccgtcaccgttttagaccccttagaagccttccccgattcctgttttgtggaggacccggcggtggtcgccgctgactttgccgtgatcaccaacccggcccgcgccagccggaccccggaacgtggtttcatccggctagccctcgaacacttttattcccaggaccacatctttgagattaccgcccccgggcacctggagggcggcgacgtgatggaagtcgacgggacttattacgtcggcttgtcggcccgaaccaaccgggaagggttcgaacagtttaaagcaatcgccgctcagtttaaccacccggcgcttgcggtccccgtccacgacttcttgcacctcaaaaccgggacgacttatctgggcgatggcaagctcctggtaaccggtgagttcgttaaccaccccgcctttgctaacttcacccaactggtcgtccctgccgaagaagcttacgccgtcaactgcatcaacaccggtaacggcgtcatcatgccggcgggcttcccggtggttaaacaattgttggaggaccacggcttcccggtctttgaagcggcgatgagcgaatttgaaaaaatcgatggcggcctgacctgcctgtcgctacgcttcaccgctcattaactcttaaattttcttgttgacaaggaatgggcgcccgtgttttaatacattcaacattaaaagattctaatgattcaccggaaccccagtagtgatccgctccctggctaagagagttaacggcgctgtaagttaacccacaacgcgatcacgaattacactccaaccaaggtgactcacgcacggcgcgatagtccatttgaggtgcaatgcacaaagctgggtggtaccacggtgaaaatcgtcccttgcctgttgatcaggcagggggcgtttttattttaaggaggtgaaaacgatgccagtcaagaacggtggaaagggctattatttcaaaacgattgttgccagtcgctttgagactaatagtgaaaaagaggaattatcatgaaaaaatttaaagaacgggttgaaccgaccttcagcctgaccgaatgtatcttggtcctagtcgttatcttgggcctgctgggctttttgatcatcgtcgaaaaacaagaaccccaggcgccgctgctgatcgcctttgttatcttaatgctttacggccgtctacggggctttaagtgggacacgatcatcgacgggatgcgcaccgggctacgggccggcgtcgaccccctggtgatcttccaaacgatcggggtcttgatcgccacctggatcttctcgggtacaatcccgacgatcatgtactttggctttaagatcatctcggttaagttcttcctccccaccgtcttcatcgtttgcaccctcgttgggatcgcctgtgggtcttcgtttaccagtatctcaacgatggggatcgcctttattgggatctccgccactttacacattagcctgccgctaacggccggggcaattgtttccggggccttttgtggctccaacgtttctccactttctgggacgacgaacctcgccgccaccaccggggaattagacatctacaagcacatccgctcgctggcctggaccgatttgccggcctggatcatctcactggtgatcttcacggtggtcgggatgagcgccaagaccgctagcctgcactcaattcacgtcatgatggaggggctgaaggccggtttttggatctccccaatcaccctcttgccggtcttgttcatgatcatcctagcgatcctgcgggttccggcgatcccgtcgctggggctgggcgccctctttgcgatcgccttgggctggctctacgaccccaccaccacgatcaccaaggtcacccacctgatcatgaacggctacgttgcccacacccctaacaagacgatcaacctcctcttgtccaaggggggtatcagcagcatgttaacctcgctgtccttaatcatcttcgctctatcactggggggcttgttgattaagttccacatcattggggcgatcgtcgacaaggtcgaagcaagcgtcaagggactgggtggtttaaccatggccaccgccctgacttgtatcggggtcaacctcttagtgggtgaacactacttagccattatcttaccgggggaatcctttaaggaagcctttgatcaccaccaccttccccgtgaactgatgacccgggtcctaaacgacgtcggggcggccgtcaacgccatcgtcccgtggagtgtttccggggtcttcatcgccgctaccctccaggtcaacccactcgccttcgtcccatttgccttcttcccgtttatcgtgaccatcctggccattttgatgggcttcgtgaaggcgaagagcgccaagcagatggccgtcaactaaataaaaaagctacactaaaataagacccccgcaccacaggcgggagccttattaattactcgatatttttcactggcttaccataggaacctccttatcatggggcaccttgttaatcaaaaaagcaacgccccgacgacgttgcttgtaatttaattagttacgtgggaattcaattccggccttcacccgggccttttctaagaccccaacgacggcaactgattcgtccagcaactggtaggcggcggcaaagtcttgttcgtcgatcatccggctaaagtcgctgaattcctgggtcatccggtggtaaacggccccagctttaaagtcctcggtaatcgttgcccgcacctcggccccggcggcgtcgcgcaccgtagcgtggttatttggatcaacgtaggtggtggtcagctcgcttgcgatgttaggcttgctggcaacgtgcatgaaaccttggtccccttggaaggacaggtagcacgggctgtcggaatccttggccccggtgcaaactgcgctaaagccgtcatagctaagcaccaaggtccccgaggtatcgaccccgtttggccccaagttcgggtagtaagtggcgtcgttaggttcgccaaataagccgacgcagtagtggacgttgtagacgttgatgtcatacaaagcgcccccgtaaaaggccgggtcaaaggcgtgcggcacttccccaccggccttgtaggcatcgtagcggctggagtattgcgagtagttgcaaagggccatcttaatgttgcccagcttggctacgttcttcttcatttcggtgaagacttcgttgtgtaaaatagtcacggcctcaaagataaagcgccccttttccttggccaggtcacgcaattccaccgcttggtcataaaagccggtaaaaggcttttctaagatcacgttcttgccgtattctagggcttgcttggcgtacgggtagtgggcactattgatcaggccgatgtaaaccgtatcggcggtcgattcttcaagcaactgggtgtaatcggtgtaaacctctggaatctggtactggtcggcaaaggcctgggccttgcccttgctccttggccgggcaaagatcgccgtccgctccaagttctccactggttcaacggcgcccaacgcgtcagaaacaatctttccggttccaataaaggcaagtttcatgatgcttcctcctaaatcaattaactaccccttattatacctgaaagcgccttaccttaaaattgtaagctcgctgaataaccttgtagctcccctttaaatcatttgcaatccgcccttagattgactatcataataaacgaaaagaagccaccgagtgcgagtcggtgacttcaatcacagttcaggtgactgagggtaagctagtcgtttcggctagcttttttcaatatcgcataggcaacggcacagtccttaacgaacttgccaagtgccacgataattaacgcagtggcaatcaccaacatcctccgatcttttccggtttgacattgtcctcacctcgcatgatttggaatttgaggggtgatgcgactatgccgaaatcactaagcccttcatggtgggagcgacccaccaatccacgcctagcttaattttaccatgattaagctaccgcagccgatgctccaaaaacgttttggcttaaccacccgccccctttgtgcaaaatggtgaatcaatattagtaacctgtgctatacttctaaagtgtggtttatcggttgatatatgtattcaacgatgacccctaaatttaatttaacggccacccgccagtcttttcatggggattacacttccaggtggctttgaggaggagtagtcacatggtttacgatgacacttgggaagacattaagtacgctttaaaacgcttttggcggcccggcttaaccgcctaccggaaggtactggcggaataaaccgaatttgcgggatagccagcatttgatcaggaagccttcgctggaattgatgagagcatcatcccggcgtcagttcactacgggatccccgagcaggtgacgggcgacccggaaacggcgaacctcttcatctgcttaaagaacccgagttgcccggttgaagcagaacaagagccctttaccggggtacaagactactttgcgcgggccgaagacctagtcaaagatgctgaccaagtagcggctaagcgtttaatctacaactttaaaaacaacattttcaaagaaccggttggcgattactacatcaagcaatacctgactggtcccttccgttcccggttcgaagaaattgccgggcgaccgctcgatccccaaaacaaggaatccttttatggtctgaaaatttctaatctcgagttgatcccttaccgctcccggcacccctttaaggaaaatgactttaagcgcagtaaggcgacccagttgacggtccggatcatcattcgccggatcgtggattactggcagggatccgtctcaaccgccgtcgccccgctcttcgtgatgcgggcatggaaggagtaccacgctgaaatcgatcgctacttaaaggagtacccgatcgtgctggccgacgaggttatcaagagctttgacgacatcatcaccttcaactacgctcacaccggcggctacctcttcgctgccccgtcttcacaaagcacctccttgggacccaacagctgctttatcatcggcccctaccaagatacccttgacgccgtcatcccccacttaattgaatcaaattaattacaaaggctaggaaaggcgtttttcctggccttttactatcttttcgtcagggcgccgcaccattaattaaacaagtgcaccctgctcatctttttttacgccatcaaaagccggtgtgacctaatttctgcaagcccctcctggataaaacttaattttattttcaaaaactggttgcgaaattaaaaaatgatgttaagattagaaaacgttaagagataacagatttttaccgaaaggggtgtccaccatgctagtcattattattagcctactaattagcctaattctagtcattattacgcctagcataagtgaacatcccggccaaaaactacacgcacggattcgtgagggggaccctgcacgactaagtgggtaaggtttagctatcttcgattaaaaaatcgtgagacccggggtggtaatcagccccgggtctttttatttgaaattggaccgttaagattaggagatgaacaacatggaacaagcagcaactacaaacgccatgaaccgcgttgacgttcaagaagccaagaaaaccgtccgcgattacgcctacaatctctcagccgcgattgccaacgccatcctggttaccctggggatggggctgttaatgcaaaccgtcgctgggttcgtccactggcaaccgctctttgaagccggcaccctggcccaagccctgctcgccccggccctgggattggcagttgcctcccaactggaggtcaccaccctggttaccttctccaccatcatttcagccaccgtggccgccaacgccgtttccttcgtgcaaacggccagcaccgcgacggccatgcaatcggtggggggcactgctcacccactggtcgttggtaacgccgtcttctccacgggacaacccgtttccgccgtggccgcggccctgctggcggccctcttagggaagtggctgtccggtaagacgccgctggacatggtcttggttccaatggtggtcaccttcgtcggcaccttcgtcggcttcggcttggcttccgtagtgacgcccgctttgaccgccactagtgcttggatcgctgcctccatcaaggttaacaccgtccttggttcgatggtcatctccgccgtttgggccctcttcttgatgaccccggcttcctcggccgccctggccgtcgccttgactttggacccgatctccgcggccgccgctgccatcgggacgaccgctcaattcgttggttacacggccatgtcttggcgccaaaacacgccgggagctaacattgctcagttcgtcgtaacgccaaaggttcaattccccaacctgatcttgaacccatggcaaatggttccgggcttagtcgctgccatcgtttgtgccccactggccaccaccctttctggcctacgcgccgcctacacggttgggggattagggctgaactccttcatcgccccgatctacttctggggccaaggcaccaaccagttcgttgcctacatgctgtggggaatcgttatgccggccgtgatctctgtcttcctcttccaagtcatgaagaagtttggtctggttaaggacaaccagttgcacttggacattatctaagttaagggaagtgcgacccaaccataaggcaggccgtgggctaaggatagggggaaggttgatgcggcacgcatcgtttttcacccagacttagccactaggcctgcggttggggagcacgttatcagtgagtgggaactgacctcctagacagaccgtatgactaagctagggcgaaggttggtgtcttggcaccgttcttcgcccgtacttagacactaggtctgtggtcattttccacgttatggaagtgcgacccaaccattgggcaggccgtgggctaagctaaatacgaatcgcaccgttatctttatagacgccaaaggggctggaagaaattgatcttccagcccctttcttgttggcaatcccagctgggcgccgagcggttaattaaattagctactacctattcgtaatgtgaccacgcagaatagatgatcacagtttgcgtgtcttgatcaaccttatagacgagtcggtgctgaatgttaatccgccgggagtaaaagcccttaattggcggtaccaatttttcaaagccttggttgggtgccaaggtgtctttacggagctgctcaattatttgcaagaagctcttttctaaatatgaccccttaattttcttaagttctttattagcgctccgcttgagtttgatcgcgtaactcatagttgaccccaaacatcatcaaagtcgtcgagcggctcgttttcccgttctttaatttgcttatcaacaccgtgattaaccaaaaataacgtttcttggattgctttccagtcatcttcaccaatgacgacaacgctcttttcatccgccttggtcggcttaatcacaacaggctcattattttcattgatccttttgattattttgaataaatctttccgtgcttgcgttggggttacaatttggtccatccaatcccgcctccctcgttctttacgtacatcattccgtacactcactatagcatgtgtacttgatgatgtacattaaaaagagtaatgaaaaatcccccgccattgctgatggggaatttttagctctttatctaatgtatattctgggcgccgagcggttcctgtgggcctagaataaaaagtgtacaagttaaatagagactctgatttagtataattaaggaagtaaattggaggatcaaataatgacgaagcacagttatgacaaggaatttaaggaacaggccgttcagtattacttagataacaaggatcacatgaccatgaatgaaataagtaagaatctaggtattggggctagtacattacataaatggattaagctgtttactgagactggggagtttggccgtggttccggtaattttgccagcgataaggacaaggagattgcacgactaaagcgtcaacttcgtgacgctgaaggagcgatcgaagtatttaaaaaatcaatcgggattctgagcaagtaactaccgaaaaggtataccaagaaatggacgttcagcacgctttggaatcccacccttccatcaatggtatgtgtgattatgttggaatctcaagaagtggttactatcaacgagaaaagcgtcataatcaccaatcaccgcgaaagcttcggaagaagtttattcaaggtgaaattaaagcaatttggctcaaaagcctttgtatttacggtgccggcaaaatcacccaagaacttcgctcaaaaggatataagatcgctgaacgaactgttggtaagtatatgcgtgaacttgacattcacgccgtttacctaaccccttggacgactaccactcgcaattctaagtttgataaacagctaataaatattttagacgagcagttcaatccattgcgaccaaacgccgtttggtgcattgataccacttatattccggttcatgacggattcgtttatttaaccagtattatggacttgtactcccgacggatcattggttgggacttatctgaaaccttggaggtatcgaatgtcatctcacttattgaaaagactaagcacagtcgacatattagcaagccattaatcatgcacagtgatcgtggtagtcagtttacgtctgaagcttacaatcaagttacagctaacatgacattaagctattcaaagaaagcttatccttgggataatgcctgcattgagtcgtttcatgccttaattaagcgtgaatggataaatcggtttaaaatccattcatactccgaagctaaacgactagtttttcagtacattgaaacgttttacaacacagttagaattcacagtcactgtgaattcaaatcaccaaagcaacttgaagatgagtatcaaactcaaattcaaaatttagtcgtggcataggaaaaaaagtctctatttaaattgtctattttattgacaggggaccaatctctgctaagattaccaaataaccccgacaaaacggttaaactcaatccaaccagattcaccatgatcggagcttgtgctggcaatgaacctcacacgatactaacaaaagaaatcatcatgcaaaaacatagcgccatcaccataaaaaaatcatttaacaacgcaactgaacaaactgtcgtcgccggtggcttgttctaatatgatggaaaaagcatagcaacaaccgactttgggccttcaaacgaagtaaccaaaaatagtttgcaatcagtttccagtacaactattgctagcatcgaaaaaaacgaaatgaggctgactaaggcatatcctaaatccaataattcctcaacaaccgctagctccagttcaagcaatagtcaaacccagcaccgtaaactaaccgctaatgaaattggcaatttatatgtgaaacaactacgtatccatcattatcttaataatcactacgttgaaatcattgttctaagaaatacgagtaccggcggctacacttttaccgatccatcgcacgctcgaataaaaatttatatcctgcaagtaataacaaacaataaaacaaatttgcagtctatcctagttaatcgacctcaagatgcaacattaatgaaccccctggattctgagcgtgcacagagcgcctttgactttgaagcaagcatatttgacgctgtttattcaaacaataaaagaatcaattaaactcatacaggagaaaaatcatgatatgtaaccattgtggcaccgaaaacgatgctaccgctaaattctgtatatattgtggccacgcactaattggccctgaatcagcaccaaaacaagaagcttattccacaaatcaatgcccaaactgtggtaccgaaaatacaccgtcagctaaatattgtgtcagttgcggtcatgcacttacaccatcaaaacatgttcaagattctcaaactacaacgactcaggctagcacaaaatcccgatcaacagcacgtaacactagtagtcctaatacatcatctcattcatattttttactcaaactagtcatcgtagtcgctattttaatttttgctattccaaaaggatatgcatatatccagcaagcgatgattcccaagggtagtgctgattacgatacaatcattgaccacgtaaccaaacacgatggtcaagatattataatattgcaaatgaaagatcttttgaatcaggcaaccgtaaatgaaagcccatctgtctttattgaaaagaataaggataccggtcggtacgtctttccaattaaaattgctaagaaaaagacgtactgctatgtcgttaaggtcatcgagcaattctatgccgatggtagttataaatattcctacgttgcggtatctcttgataaaaacaagaaaaacaaatacgaaaataaaattctcgatcctaatcattttgaaaaagagttccatcaaaaagacgcttacggttataccgctgatgaattaccaaattaattaattaggggcacatcgttctaagccgatgtgcccctaatttaaacacagtcaaaatcagtggtaaaaggccctctggtcccctgtcaataaaatagacaatttaaatagagacttttttgtcctatgccacgactaaattttgaatttgagtttgatactcatcttcaagttgctttggtgatttgaatccacagtgactgtgaattctaactgtgttgtaaaacgtttcaatgtactgaaaaaccagtcgtttagcttcggagtatgaatggattttaaaccgatttatccattcacgcttaatcaaggcataaaacgactcaatgcaggcattatcccaaggataagctttctttgaatagcttaatgtcatgttagctgtaacttgattgtaagcttcagacgtaaactgactaccacgatcactgtgcatgattaatggcttgctaatatggcgactgtgcttagtcttttcaataagtgggatgacattaagtgggatgacattcgatacctccaaggtttcagataagtcccaaccaatgatccgtcgggagtacaagtccataatactggttaaataaacgaatccgtcatgaactggaatataagtggtgtcaatgcaccaaacggcgtttggttgcaatggattgaactgctcgtctaaaatatttattagctgtttatcaaacttagaattgcgagtggtagtcgtccaagaggttaggtaaacggcgtgaatgccaagttcacgcatatacttaccaacagttcgttcagcgatcttatatccttttgagcaaagttcttgggtgattttgccggcaccgtaaatacaaaggcttttgagccaaattgctttaatttcaccttgaataaacttcttccgaagctttcgcggtgattggtgattatgacgcttttctcgttgatagtaaccacttcttgagattccaacataatcacacataccattgatggaagggtgggattccaaagcgtgctgaacgtccatttcttggtataccttttcggtagttacttgctcagaatcccgattgatttttttaacacttcgatcgctccttcagcgtcacgaagttgacgctttagtcgtgcaatctccttgtccttatcgctggcaaaattaccagagccacggccaaactccccagtctcagtaaacagcttaatccatttatgtaatgtactagccccaatacctagattcttacttatttcattcatggtcatgtgatccttgttatctaagtaatactgaacggcctgttccttaaattccttgtcataactgtgcttcgtcattatttgatcctccaatttacttccttaattatactaaatcagagtctctatttaacttgtacactttttattctaggcccacaacggtaccacggcgtaacggaatgtaagtagcatcgaggaacacacagacgtactgtgagtacctgaatttgcgctcgtggaactcttcaaccaggtgttccgtccgcttagtgatgtttgaaaccgtggttggtgagtagtagtggccgtacattctctcaaccatatcagcgatttcacgagttgtgacgcccttggagtacatcttgatgaccattttctccagtccatcagtccgacgcacgtaaggagggaagagggcgttttgaaacttgtttaaccggtcccgtgggatcgtcagattaatttcaccgtactcagtgtcgatcgtgcgggtgtacgccccgttccggtagttcacgtcgtcttttgatcggtcgatccgagtatgtggttcgtagcctagcaccgcagtcagttcattttgaaggaactgattagcggccacttcgatttgacgacgtaagacttcattcagggtaatatttttgtctgaagatagcgctgcgataatatctttgttaaactggttcatggggaaagcctccgtattctgattggtttttagcgatttcaatcatacggggaaggctttcccttttcaataccctcaaggtatcaatttacacaaaatattttacactccctgaatatccctccattctccataaatcatggccattaataattattatcgccagcagatttcttttctaccgataaaataaaatctgccattgttgttgctgaatttacagctaaccttgcatgatgcctatcaatagtcagtcttctctctccaacaccatgagagtcactatttttatttctcatttctgatactgctgacacgatattctctaatcctgataataggcggtttatccttttatctgcatttttgttttcatgcattttgtattcatctttaacctgtttatataatttatttatatcgcccttactacttggttcaatattttgcttttcaagaacgtaatcaaacgtttcttcaagaatagtccttgcttgagttaaagcactgtcgtagtggccattttcaatgttgtctatagctctatcagataatgattttatataatcacgatcaatagtctttaaattttttattgaaatattaggagtggttgcattaattggaacaattagtacccttttgccatcgatgattattttattaccaccaaaatgaagtatgtcattaatcctacttaccgcactctcaactgacttattgtgatatctttcaaactcttctttatctaattcagtaacagctcgtataaaattcgatttatcaaatagataagcaagtatattagctattcttccagattgaataccgtaatcaataaggtcaaacatatattgccatctagaatatgaaccttcatattctactgtcgagccaaacatttttgctatatcgcatatatcaggaccacttagtcttggtaaaccaatttgtaaattagataatccaaaatttgattgtatatttggcgattcaaaatctccaaatgtttcatcaccatctaaaatttctgcaatttttttattcttcaataacttatatttatcaagatccatatctaccattttcctttttataattttgtctatcccgattatactattgtcatctaatacacttaacagcagaatagaattacttatttactactgtacacttattaattcaactctcagttataagccatttttgcactaaccataaatcacgtcatatcaaaactcactatcctaatcgacacgacctgccaaactggacattcgcctactcgaccatcgaaataggacatagaacactcgacccgccagcttcaaatagaaaaagtgtactaattccaatcgttcagaaaggaaaaagtacactttcaatcacctataaatgccgtcagagcgcggcttatcggctatttatctgtacgctccagcaccgtaacactctcaacatgcgtcgtctgcgggaactggtcgaccggttggatcggcttggtcacgtggtagccctgttcggcgaagcgttgtaagtcgcggaccaaagtcgccgggttgcaggagacgtaaatcaccttttggggcgccatcttaccggtggcctcaatcaattgggcatccaagcccttgcgcggtgggtcaacaatcaccacatcaggtttgagaccctcggcttgccacttggcaaactgctcttcggccttgccaacaagaaaggtcgcattttcgatcccattattggcggcgttttgcttggcgtctgcaatggcggccggcacgatttcgaccccgtaaacgtgcttggcgtgcttagccacggctaaagagatcgtcccaatcccacagtaagcatcgataacggtcttgcttccgtctagtccggcgttttcaatggcggtctggtagaggcgctcggtttgttgcgggttgacctggtaaaaggagagcggcgaaatcgtgaagtcgatccccaagagggtgtcgtggatggttggttccccccacaacaggtggttcttcgttcccaaaatgacgttggtccgcttatcattgacgttttgcacgatgctcttaattcccggcacccgttcacttatttcccgggtaatttctgcgacgtgcgggaaatgcaccccgttagtgaccaggaccaccatcacctggtggctgtagtggccccggcggaccatcaccgtccggattacgccgcggtgagtttcttcatcgtaagccggcacttggtacttacgcaagaggtcgcggaccaccaaaacggtttggtcaattgccgggtcctggatgtaaaagtcttcaattggcaccaggtcatggctaccacgtttgtaaaaaccggtcgtcggttggcccttaaccatccgcaccgggacttgggccttattgcggtaaccaaagggctggtccatccccagcgtttcggccacttctaagtttaggtgggccttttccaagagttcttgaatttgacgctgcttaaacttgagttgggccgggtaagtcaggttccctaacggcgcaatccccgtctgtaggtaggcccagttggggttatcgatccggtccgggctcttcttttcaatgctgatcagcttgccccaggcgaagttcttggtcaccttagttaccttaaccgttacctcttcgcccggcaaggtgttgggcacaaaaatggggtagtgatcaaccttgacgaccccgttcccttggtaagtcaggtcgaggaccgtccccgtgaccgtttcgtttttatgaactggtagttgcaccttactcattgctttcctccgtatattgtatgtacaacgggcgccgtaattgcgcccattacaagaaagaggggcccgtgcgtttacttaacggttgggtccctacttagctaattattactcttacgtatccttttccatttcgcccaagccacgcacgaagtcgtcttcggccttttgcatgtccggcgtaatgtcgctggtaatcgcgtcatccgggatcgcctccatgttggcgacgaccgtcatgtgctggtgcaggttatggaattccatcggggcgtccccaccgtattccccgtccaagttgatcattaaccgatcgtttggatcaaggggcttcaccgttacgtccttggccttcacgtagattacccgcggatcatcaatgtgggtcccgtttaaggccttggccatcagctgcatcaggcccaggaggctcgaatccttgatgattaacaaggagaagttcccgtcatctaaggaagcatccgggacgatttgttcaaagccccccaccgagttagttagggctaagaagatcgtggaggccttgcccttaaaggtttgaccatcgtaagtgatctccatggcgaccggcttaacccggggcaggatttcggcgcccttggcgaagtaagccaggtagccaaacatcgacttcatttgtgacggcacgtcgtaggtcaactccgtcaaggttcccccggccgcgatgttcatgaagtacttatcaccggcctgaccgatgtcgatcttgaaccggttggccggctccaggatcaacttagcggcggccaccgggttatcgcgcggtacccgtaaggcccgggcgtaatcgttggtggtcccggcggggatgatcgctaacagcggccgcttctttaggcccgctaaaccatcgaccacttcgcttaaggtcccatcgcccccggcggccacaatcaggtcaaagccttccttgactgcccgggccgcctcattcttagcggaatctggttccggcgtggtggcaaaggcactggtttcataaccggcttgttcgtaaacatcgaggatgtcgaccaagtcgttgcgcagagcttcccgtcccgacgtcgggttgtaaattatccgagctcgtttggccatgaccattcctccttaacgttcgttgagtgacttacccagtaattggttaaccaccttcgggttggccttcccctgggtcttcttcatgatttgcccaatcaagaagccaaaggcgcggtccttcccgttcttaaagtcttcaatcgattgttcgttgtcgtccaagatggcatcgataatcggttgcagttcggccgggtcagacagttgcaccaaaccgttagccttagcgaaggcggccggttcttgaccatccaagatcccttggaagaccttcttggccatcttcgaggagatcgtcccgtcgtcgatcaacttgatcatccccgccaggttggccggcgtcagcttagtgtcgtccaggtcaacgtgttggttgttcaagtaggagttaacgtcgttcatcaggtagttggccaccttcttggcgtcgccaccatccttgacggcctcttcaaagaagtcggccatttccttggtctgggtcaaaaccatggcgtcgtaatcagtcaggccgaggtcgttaacgtaacggcgccggcgttcgcccggcatttctggcatttgggaccgaatttcttcaatccaggcgtcatcaacttccagcggcggtaggtccggttccgggaagtaacggtagtcgtcagaaccttccttggtccgcatcgccaccgtccccttcgtcgcttcgtcgtaacggcgggtttcttgaacgatttcaccaccggccatcaagaccttttggtggcggtcggcttcaaagttcagagcgttcttgacgaagttaaaggagttgatgttcttcatttccgtcttggtcccgtactggtcggagccgtatgggcgcacggaaatgttggtgtcgacccgcatcgacccctcttccatcttcacgtcggagatcccggtaaattggatccgttggcgcagggcttccaggtaggcaacggcttcttctggcgaagcgatgtcggccttggaaacaatttcgatcaacggcgtcccctgccggttcaagtccacgtaggagtgactgccggtgtgggtgttcttcccggcgtcttcttcgatgtgcatttccttgatcccgatctttttcttcttaccgtcaacttctatttccacccaaccatcgtgggcgatcggcgtttcagattgggtgatctggtaggcctttgggttatccgggtagaagtagttcttacggtcaaagtgcatcttcttggtcacttcggcgtgcaaggctaatgcggccatgatcccgtcgcggaccacacccttgttaatcgacggtaagacccctgggtacccccagtcgatcacgttggtgttggcgtttggcgccgccccaaagttaaccggggacggggagaagatcttcgagttggtctttaattcaacgtggacttctagcccaatcgtagtttcaaagttcataaatggttcccccctatcctaattctggcgtttgcttgtggaagtcggtcgtctgttcaaagacgtaaccggccttgtaaatcgtggcttcatcaaagcgcttaccgatcatctgcaggccaattggcatcccgttgtccttggagaagccggcagggatcgacatccccggtagcccggccatgttcaaggtcacggtcaagacgtcattgaagtacatttgctttggatcggcaatttcggcgccgatcttaaaggcggtgctggttccggttggcccaacgatcaaatcgtggtcctttaagacgtcatcgaagtcctgggcgatcaggcggcgtaccttagcggccttgttgaagtaggcgtcgtagaacccggcggacaaggagaaggtccccagcatgatccggagcttcacttcgtccccaaagccttgcgaacgggtcttaacgtagacgtcttccaggttcttaacgtcatcagcgcggaaaccgtaacggatcccgtcgaagcgttgcaaattagaagaagcttccgaagaggccaggatgtagtaagccggtaccccgtacttggtgtgtggtaaggaaacctcatcgatcgtggcacccaaggattcgaggtgcttcaggctcgcttcgatcacttcttgaacgtcgtcatcgaggcattccatgtattcgcgcggaacggcgatcttcattcccttgatgtcggcctggtcgtttaagccggcggcaaaatccggtaccggttggttagcgctagtcatgtcgcggtcatccttaccggcgatggcgctcatcaagatggcgttgtccttaacggattgggtcagccaaccaatttggtcaaaggaagaaccaaaggcgatcagcccccaacgagaaacccgcccgtaagttggcttcatccccaccgtcccggtaaaggaagcgggcatccgaatcgaaccaccggtatcggaccccaaggcccctaaaacatccccggcagccacagcggccgcggaaccaccagaagagccccctggtacccgggttaggtcccacgggttcttggtcgtcttaaaggcggagttttccgttgacgaccccatggcgaattcatctaggttgaccttcccgacgttgattgccccggcggcgttgagtttttcaacgaccgtagcatcgtaaacgggcttgaagttttccaagatcttggaagccgccgtcgtcgtcaagcccttggtaacaatgttatccttaacggccagcgggattccggccagcagttggtcttctgcgattcccgcttggtctaattcagcggcttgcttgagggccgcttcctcgtttagggccaaaaaggcgccgacttggtcatcggtggccttgatccggtcaaaggcggccttggtcagttcggtggcactcaccttcttagcaactaggtcggcgtgcagacccgaaatgtctttaccgtaaaaagtcattactcttctccgtcctcgctttcgtcgatgatcgctggcaccttgattaagccgttagccgtttccggagcgttatccaacagggcttggcgttcttggtcgctgctcttaaccgccacgtcttctcgcatcacgttgacttccgtcgttggcgtactcattggttccacgccggtcgtatcgacctcttccagttccttgaacaggtcaatgatttcttcgattttgggggtgaacttgtccaactccgcatcggtaaacgccagcttggccaggtccgcaacgtgttcgacctgttgccggtctaattgctcagccattctctcaacctcttttcctttgtgcattgatgatttatacaattccttattttatcacagttagggcgacttattaactcaagcggctaaaattcgcgccgctaacaacaagggacccgcgcagtttcggcatgccgattgcgcgggcccacgggctctgttcaaagtttggttttaataggagctaaagatgtgcgattggtaactgctggacccggagttgcggtagacgaccgcttgaattgaattcgaagattggatcttgatttcaattgggatcccgtttggtaagtacttcttggcggcctgaacgatgtattccgtgaaggattggatttcggtttcactatagaactgggtcgtgaccgtaatgttcatcccggacagggagttgttgtagtactgggcctgggccgttaccccgcttaagttcgggaagaaggattgaatctgggtcttgaagttcgtgaagttagagttatcggactgatcactggaattactagaggtcgaatcgctcgcctttggtaagacgaccgccttgtagttcaaggtcttccaagatgagatcgtggagccgttattcttgctgtaggcaaagaagttcccccccaccagtgaatcatcggaggcctgcttaaagagggcgatcacgatcggcacgttctttaagtccttacgggcccggagccgctttaaaatcttggcggcggctaacttaccctgtttttgtacctcggcgttggagatgtttttcgtgtaattcggcccatcggtggtcttttggtaggtgtattcgctgttgaccccgatcccgattacgatccccttaagcttcaaagagttaccgctttgctgcatgtaatcttgttcttcaatttgttgaatgtattctgggttcgggtcgctgctcttacccttagctgggtttaaaccagttgggttgctggacgtcttgcgccctaaccagttatccagggtgctagaagacaggtactgtccttcctggaagatgtagctcttagtggagaaaaccagcttagaaacgttggtcaacccagattcaaaggccttcaagttgtacacgttagcgttttgcgccgtgttcaccccacgggccttgctggtcttgtagcgaccgttttcgatcaccccttggtaattaccactggtcgacccggtggttgtcacactcgagctactggagctcttcttgccacaaccggcaagcgtcacggcggccaccatggtgatggcggcggccaagacgattttctttactcgcacgtctagttttcctccttcatcgcttggtcaaagcggtcttcatcccagacctcgatgccaagcgtttgcgccttttccagtttgctaccggccttttcaccggcaattaagagatccgttttcttagaaacgctcccggttaccgaagcgccccgggcactcagccactcctgggcttggccgcgggtcatcttggttagttttccggttaggaccacccgttttccggcccactcggcactttccgttgcgctggtggtgggggccaggtagtccatgttgacgccaacctcttttagttcggcaatcaactggtggacctgttcgttttgaaagtaggtcgccaccgcgtcaccgatgatcgggccgatcgaatcaaccgccgaaatggttgcggcgtcagctgccatcagggcgtccaccgacttaaattcggcggctagtagctgggcgaccttggcgcccacgtgccgaatccctaagccaaacaaaaggcgttcgcatgaattatgacgactattagcaatggctgtcaataggttgctgatcgatttctcgccaaatttaggcaaagttaacaattgcgcggcttccaggcggtaaaggtcggcaacgtctttaaccatccccttatcccagagttgttcaatgatcttaggccccaacccgtcgatgttcatggcgttgcgagaggcaaagtgggccaggccctccttaatttgggctggacacattgggttaacgcagcgcagcgccacttcgtcatcgaggtgcactaggtcggccccgcactccggacaggtagtcggcacttcgtagggcttactatcagccgggcgcttctcaattattacccgggaaatttctgggatgatatcaccggccttgtgtaacaagacggtatcgcccaggcgaatgtctttttcggcaaggtaatcgggattgtgtaaggaggcccgggaaacggtcgtccccgccagctgtaccggatccattacggcggtaggggtgacgttaccggtccgccccacagtccactcaatgtccctaacgacggtcgcctgttcctccggtgggaacttgtaggcaatttcccagcgtggcaccttaaccgtattccccagcgccacctgcgttgctaggtcgttaaccttttcgacgatcccgtcaattccgtaggggagctgatcccgttttttagtgtactcctcaatgtaggcggtcagttctgcttggctgtgaacaacccggtagttggggttgacggcaaagcccagcgcccgcatcttttcgagcgcttgcgcctgggtggtcacccctagtgcttggtagtcgggcacgtagtacataaaggtatccaactggcgggcggccgtcaccttcggatctagctggcgcagggaaccggcggcggcgttacgcgggttggcaaagaccggctgtccctccgcttcacggcgttcattgagcttaacgaaggcctccttgggcatatagcactcgccacgaaattctagcgagaggggttcgggcaggacctgcgggatggacttaatcgtcttaacgttttcggtcacgtcttcaccgatcgtcccgttcccccgggtcgaaccctgcaccaaacggccattttcgtagactaacgataacgataacccgtcgatcttaagttccaggttgtagtcaaaatcaactttgacgtcactgttgtcttgttggcggcggttaaagtccgccaattctgcgagcgagaagacgtcccccatcgaaagcatcgggatctcgtgggtcaccttgttgagttggctttccgcggccccccctacccgttgcgttggtgaatcaggtaccaccaagtccgggaagcgttgctcgatttccactaggcgttggtaagcccggtcgtaaacgtaatcctccacgctcgggttgtcctgttcgtaatactccgctccccacttcttgagctgctctcttaaaggcgttaactccgcttgagcctgttgcttggttagctcacttacggcttcttgcttactcatcttaatcctccaccttggtgattggggcaaaacttgctaagaggcgcttaaccccctgctgtggaaaggcaatgtctagttccatgttttctccggttccgttaacggagaccacggtcccttgcccccacttcttatggttaaccttgtcgccggtgttccaagacttcttttcggccccggtcccggtgttggtcttcggggcgacccgcttccccgcatcagaagggcgccggtaagtggtggccgtggcggccttaaaggcgtaggagttgcccccggcgatccgaccgcttaacgagcgttcaccctgattttggttctctgattgcatcagttcgggggtaatttcctcgacaaactccgacggccggttgcgttggatgtgaccatacagcatccgcgaaaaggcattggtgatgtaaagcttcttcttagcccgggtgatccccacgtaagccaagcgccgttcttcttctaattccttgttgtcggtcatggcccgggacaacgggaagaccccttcttccatcccgatcaagaagatgaccgggaattccaaccccttagcggcgtggagggtcatcaaagtaacggcgggttccgcttcatcgacgtcgtcttggtcggacaccagggctaaaccggccaggaagtcggttagcttttgtaggtggtccattccctcatcgtcttcgtgttggcggtcgtattcggcggtcaccgacttaaattcctccaggttttcccgccgggtttgcccctggagggttttatccttctgcaattcggctaggtagccggtccgttccagcacctggtcggtcaaatcggtgatcgaaagcaccttggcctcgtcttgtaaggcggcgattaactggccaaattcttcgatcttattgcgggtccgtgccgagatggcgttggcgttttgaacgttttgggccgccgccagcagtggcaagttggactcctgagcaaactcccgtaaccgttcgacggaggtcatcccaatcccgcgcttgggggtgttgaccacccgttcaaaggacatcgagtccaacgggttgacaatcaaggtcaggtaggccaagaggtcgcggatttccatccggtcgtagaagcggtggccaccaaccatcgtgtaaggaaccgtcgactttaggaaagtttcttcaatcacccgcgactgggcgttggtccggtaaaggatggcgaagtcttggtattggtagttgtgcttggcccgttcttcttggatctttttgacaatgaactgcgcttcatcgtgctcgttttgggcccggtaataggagattttttccccggcgccgttttcggtccagaggttcttgtccttacgttccaagttgttggcgatcacttcgttggccgcctttaagatcgtttgagttgagcggtagttttgttccaacatcacggaatgggcgttagggtagtcatgctcaaagtttaagatgttgttcatgttggccccccgccagccgtaaattgactggtcggcatcccccaccacgcagatgttttcgtacttttcggccagcatgtgcaccaattcgtactgggcgtcgttggtgtcctggtactcgtcaacgtggatgtagtggaacttatcttggtagtaggtcaaagtttccggcgcctttttgaagagctcgatcgtcttcatgatcaagtcgtcaaaatccagggtctggttgcgttccagttccttttggtaggcttcgtaaacgcgcgccaccatccggtcaaaggggcgttgatggttcttggcaaaggtggccggatcctccatcgcattcttggcgtttgaaatcgccgacagcagttgccggggttcaaacttcttggtgtcgatgttttgttcctcgcagatccgcttaatcagcgtccgttgttcgctggtgtcggcaatcgtaaaggcccggttgtagcctagctgttcaatgtcgcgacgtaaaatccgtacgcacagggcgtggaaggtcgacacccagacgtcgttgccagcctcacctaggagcttagcgacccgctccttcatttcccgggcggccttgttagtgaaggtgattgctaggatgtgccacggcaagacgtgacgctcctcaatcaagtaagcgatccggtgggtcaggacccgggttttaccggaaccagcccccgccattactagtagggggccttccgtcgtcaacacggcctcgctttgcttatcgttcattccctctaacatcgattggttctgcacgcctaataccatcctctctttaaatcgtaaccttcattataccaaatttcccgggaaatacctggctgatgcccttccctaactacactaagaaggccccaggcgatcggccatgccgaaggttactggagccccattttaagttcagcgggtaagcgtaaaccacccgccccttgactattcttcttccggtgctggttgcgttggcgacgttttcggccgcaagatttcggttgtgtcaacctgatttaacaggtcgctgagcaaggcgtctgggccaccagtcacccaaactaaccccttcacgcccttcgtcctagtcgtgtcggccgggaagaagcggaacttccagttttcctttaggacctgctgcctagtagcggaggctaattggttatcgtagagtggcactaacacggccggctgcagctggtggagttcgtggatcgccattcccccgatcacccgcagcatttgttcgtattggtttaccccggccacctcgtcaaagatgttcccggagatggttggctccaggtcaaaggaattcacgtacaacgctccggcagccgttgcgtaaaaacggacggtgatcacaccacggtagcccagcttcttggcaatttcggtggcgatccggaccatttcgtcgcgcatagcatccggaacttcggttggggtggtggcctcaattagctcccggtcctcgttgaaaaactcttcaaccagcgggtaagcaaccaccgtttccccgtccgtggccaccgtcagactgtactcggtattgtggtcaatccaggattccagtaggtaagccccaccttgaatgtagtcgtcaccataggcaatgtctgattggtgattgatccgcaggctctgttcgcccaacccccgttggatgggtttgagtaccgccgggtagccaatcgagtcaatcgattggtaaacgtcgtcgagtgaaatcaccgtgacgtaaggggacacgttgacgttaatttcatccaaaaaggcccgctccatcaagcgatcctggacgatttccaaggccgcaaccccttggggaacctgggtaaagttggtcaggtagttgatggcaaccggggcaattagggagctggcgtaaatgaccaggtcgctgttttggccaaattcggtcagtttgtcacggtcacggtagttgccaacaatcgtaaaatcggccagcttggttagttggggttgggagtgatcaacgtaagcgcccacgtttaaccccagttttttggccgccaccaacagcggccagtccttttgggttaggccgatgatgcccagggtcttcccctgggacaaaaggttttgtcccgccatcttaatcttccccttccgtttgtttgaagcttacctgaccatccgcaagtgacgaaaccttcgctagcgattcaacccgaacgcccttagcagcgagttcagcggaccccggttggaaacacttttcgatcacgatgccggcaccaacaacttccacaccggcttggtcagcgatttgcaacatcccttctaccgcttgcccgttggcgaggaagtcatcaatcaacaagacccggtccgttttatccacgtagcgcttggaaatcgagatccggttggtcgtcttcttggtgtacgagtagacatcggccgtgtacatgccggaatttagggttaagctcttgtgctttctagcaaagatcactggtacccccagggctaacccggtcatcacggcgggggcaatcccggaggattcaaccgtccaaaccttggtgatcttagcgtccttaaagcgggctgcgaattcctggccaatgtgttgcatcaaaaccgggtcgacttggtggttcaaaaaggcgtccacctttaagacgttgccgggtaacacagttccaaattgacgaattttttcttctagctctttcattagtggtgaggctccttactcatcatacttgtggaggttataagacttaatgacgttgattaacttggaagcgtaatcgggatcagttgcgtaccccgcatcctgaagggccacggcggcctgttgataggtggtggcgttaatcacgttttggtagttttgctgattggtgtcggtcccgttaagcatcaatttagtgtggtcggcaattgaatcgttccaggaactgtagaccttaaagcttcccttgatcactacccactgtccattaacgtattccttggttgagagcaacttggagtttgccccggttcccttaatcccaaataggttatggtacttagcggagagttccgacgtcccccagtccgactccaagattgcttgggccatcgtaatcgaggccatcacgtggtactgcttttgcatcgcctgggcctcgggggcaatttctttaatgaacaacttcttggcgttttgctgcttttcaatgatttgttcctggacgtggcgctggtacaagtgatagcccacgtaactccccattaacccaattaaaataatcaggacggcgaccagccagggggactttttagcccccttctttgtccgtctccttcgcttagccacaaaaaatatcctcctcagatttttcagataattgtactttcatcttaccgcatttaggcggggaagattactaatttttgtggaagatttaaactggaagtgcgacccaatctagcagacttagccactaagcccgcggttatcgttaaacttcaaggaatagaaaaaggccgggaaaaatcgtgtttccccagcccgtttaatatttgaattttacgattagttaacgtggcccttaacctatcgaggaggttggtaatcactcacctaaatgttagtggaattgcatcccaccgtcgacttctagggtttgaccggtgatgtaatcagagtctggaccagccaagaaggcgacggcgttagcaacgtcagacgcttcagacaggcgctttaaggcgatatccttggcgaaggtttgcatcccccattcatcgtccttaccggcgttttggccaaccttgtgagcgatgtcgtacatcattggggtcttcacgatccccggggcaaaggcgttgacggtcgtgccttcttcggctagttcacgggcggttacttgggtaatcccgcggatggcaaacttagaactggagtaaacggtcaggttcgggttccccaccaccccggcttgggaagtggcgttgatgatcttacccgggtgccccaacttcttgaaggcggcgtgggccgcttgggtcccccaaatcacgcccccaacgttaattgagtagacgtaatcaaggtcttctggcgtcaccgtatcgatcggcgtggtcggggccaccccggcattgttaacgatcacgttgaagtcacctaattctgccaccgtcttctcaacagctgcaaagacttcgtcacgcttggcaacgtcggcagttaccaccagggcttgaccaccctcggcttcaatttcttgcttcaccttttctaaggcgtcggcgtggcgagccactaaggcaacggcaaaaccgtccttggctaaacgcttggcaatggcttccccgatcccttggccggcaccggtaactaaagcaactttctttgacatgtggggttccccgctttctctcaatctgtttagtttgtgaaaacttgatcacggctttaattgtaacagacttcacaaagaatagctatcccccttttgacttttccaaccctaagcttcgatttaacgttaaatcaatcaacttccccctcgttcccgtacgttgtttaattaacagagcggtgcccctattttattagtaataatcacgtgatcccaagaagggcgttgcttatttagcaacccttttcacctgtggtatgctaataaaatcaatgagagaggaaagatcaatgcggattgtcaaccaccactgactaaagtcagtggcttgtgagccgaatatcatcacggatttcgaaccacaatttgcgtagatagggacaacttatttgaccaactgaaattgtaatcaaacagcggtcgtctaattaccaacgccttttatgtccccaggttgccatagggacagataagctaggctagtttagctattcccttatcaagaatgtttttagctgcgttccagtcacgaatatggtgaataccacagttaggacaagtccagtttctatcatctaatgttagtttgtccgtcccattagtgcccattacaaagccacaatcgcgacatgtttgggtagtatttcttgggttgattgtgataaattgacgcccataaagctttgctttataagccaacatgccaagaaatgttcgccagccaacgtcagaaatactaagtgccaaagcatgatttttaagcaaatccttgctacgcaactcctcggctactactaaatcgtggttcttgattaatgcggtagaaatttgttggagaaaattatgcctttggttcattaccttggcatggagtttagcgactaacaagcgctgtttttgataatttttactatctcgtaaagaacgatgttctttttttgcacgttgttgccgtctagataaaatgcgctgttctttggctaatttgcctttaatagtgcggtaatatcgtggattaggaactatgttgccttcactgttggttaagaagttatcagtattaagatcaattccaacatgtccatgagtagctttggacactttaacaaaagattcatctgaagctaactgcattgataaaaagaagcgatccgctgaatctttagtcaacgtcacggtaccaattctagtctcgcatattcttttcaaaagccgtgcttgcgaaccggcaacacgtaacagtcctattttaggtactttgacatgactattatctagaaaacagactgtaccattagttagcaacgcatttttttgccccgggtattgacaattggtttgataccgccagtgataactctttcgatgaaatttgggaacgccagtggcgtgaaccttccgaaaagcattccaagcttttcgatagttctgaatggcattagctttcgtcaaactatcaattcgtttatcttctaagaattgatagtgattagacatttgcttagcgttttggcgcatagttagttgcttaatacgatcctgaactatgtcaatcggtagcttaactctgcgaagctgcatcagttccttattgatcgcaaccatttcgttatagataaagcgactagcgtcactgttgattttaatcaactgcttttgttggtcactaggatagcagcgcatttttaggccataatgatatttcatttttgccattgacttcatttgatttcacctcctttattgatatgataacattatatcatgatgtcaatgtattaacaaaggagagcatattatgactaaagaaaaaatcaaagataccatttatactcgtcgttatatctataatttccattatcatttgatctgggtaactaagtatcgcaatcagacttttacaaccgaggtcttatctaacgaaatgaaagccatcttgcagcaagttgcagatgacaatgacatcgtaatcgaaaagatggaagtcatgccggatcacattcatatgctaatcagttttccgccaagcaaagctccggctagtgccattaaggcgctcaaaggacgtagtgcctatatttttttacagaatcatccagaaatacgatgtagccaatattggggcggtcatctttggtcgccgagttactatatgagtacattgggcaatatgagcaaagaagttgtcgagaaatatatcaatgaccaaaaatatacagaaacaaacaaaaagccccataaaggggctcaatagtggcctatccatcccatgactaaagtcacgggatttccggctaatattaattaaagaggagcgccctgaccttgctggcggtaatcaccaccctagtactagtggtcgggggctacgttttatacatgcaacaccaatactaccggattcccgaccaccagaaactaacgatcggcaacaatcaagcagccaccataacgaccggtaaggtctacaccgccactacttacaacgtcggttttggggcctacaaccaccagtttagtttcttcatggacgccggcgagcttaaaagcggcaccgagacacggggcaagtacgggaccgcccgctccaaggcggtagttttaaccgatactaagggcgttgaaagggtcatgcaagcccaacaagccgacttcatgctctttcaagagattgacaccaattcgacccgctccaagcacgtcaaccaggtcaggatggttgaaaataagttccacggttacggtcacgtctttgccaataacttccactcggcctttttaatgtggccactcaccgacccacacggtagcgttcaatcgggccttttaacgctgagtcgttaccacattggcagtgctacccggcgccagtacccagtcaccaacagctttatctccaagtttaccgacctggatcgctgttttgccgtcaccaccatcccggtcactaacggcaagcaactacttttaatcaacagccacatgtccgcctacgacaagggcggtaagatgcgtaaggcccagatgaaacttttaaacgccgtcattgaacgggcatacttagccagcaactacgtgatcgtcggcggtgactacaatcacgccctgggcaaggacatgctaacccacttcgccagccaagaaaaagtgcccgactgggtctccgtcttggaccaaagcatggtcgccaagggcttcaccatggtcaaggcccaaaaccgcgaaacggtgccgaccgttcgttccaccgaccttgcctatcgctccggcgtcaactacctgaccgtttgtgacggcttcttggtttctaacaacgtcacggcacccgccactaacatcaacaccgactttgactacgccgaccacaacccggtcaagttaacttttatcctcaagtaagcataaaaaaacaccggcaagccggtgttttgataagcgtaacccgtagattaacgcttactgaattgagaagccttacgggccttcttgagacctggcttgcgacgttccttcatccgtgggtcccgggttaagagaccagccttcttcagggcatcgcggaagtcagggtcaacggtcaaaagagcgcgggcgatcccgtgacgggttgcaccggcttgaccagagaagcccccaccgtttacgtttaccaagacgtcgtattgaccttccgtcttagtagcggcaaatggttggttcacgatggcgcgtaagttggcaaacggaatgtagtcttcgattgccttgccgttcatagtaatgttaccagaaccaggtaccaagcgaacgcgtgcggttgcatccttacgacgtccagtaccactgtattgtacttgttgagccaattccgttccctccttagattaagttagtaatgtcgagtacttcaggcttttgagctgcttggttgtggctttcaccagcgtaaacgtgcagcttcatccccatcttccgaccaagcgaggtgtgaggaagcatccccttgatagtttgttcaaccatcttttcaggatccttagctaagaagtcaccggccgtgcgttgcttcaaaccacccgggtggttggagtgacggtagtagatcttcccagttgccttcttaccagttaacttaacttctgcggcgttgataacgatcacgtagtcaccggtgtcaacgtgcggagtgaaggttggcttgttcttaccgcgtaaaatagatgcgacagtagaagccaaacgaccaagggaaatgcccttagcatcaacaacgtaccacttacggtcaacttgaccaggttttgccatgtatgtcgttctcacgattaagttcctccaatatttgtctttcttttacaataaattgtgtaccgagtaatttatggaaaagaaataccatttagtagtttactcgttaaacccgttggcgtcaatcattttgtgaattcgccggggaatcataggtcacttccaccaggtataagccactggccggcgccgttccccgggcgagatcgcggttcttggccttcattacccgcataacgtcatcgacggggcggcggccgttaccaatctccagtaagaaggccaccataatccggacctggttatacaaaaaaccattaccaacgaagtcaaagaccacctcgtcgttttcttcatcccgaaccacggttacctcatcgatgcggcgaacgttgctggtcgcttgcgacccagaggcaacaaaggaggtgaagtcgtgttcaccaacgaagtcctgggccgctgtttgcatccgttcaacgtcgaccgggtacttgtaatggccggtgtaattgcgcttaaaggggttggtgaactccccccccaccacccggtagcggtagcgcttatggtgggcatcaaagcgggcgtgaaagtccggcgccacttctgttgcctccttcaccaagacgtcgagggggaggcttgaattcagggcccgcaccaaggacggccccggaatttggtatggtaagtcaaagtgggcgacctgaccgagggcgtgaacgccagcgtcggtacgtccggaaccgaagaccattagcggcggttgtggttttttagcgatcttattaacggcccgttcgaggacctgctgaacggttcgctcaccgggctgaacctgaaagccagcaaagttactgccgtcgtaggcaaaggttatcttataacggtgcacaagaaccgtcctttcttaaagcaaaatccgggcaacaaagaagagcactgacactatcaccaccaccgccagcgcaatgctgtcggggcgccgccaggttaattgacggtagcgggtccgctcctgatctggatcgtagccgcgggcctccatggccaccgccagatcctcggctcgccggaaggccccgacaaacaggggcaccatgattggcaccatgcgcttgacccgggtgtagacactcccggaggtgaaatccaccccccgggcctgctgggccttaacaatcgtgttaacttcatccatgatcgtcggaataaagcgcagggcaattgaaatcatcattgtaatctgattgaccggcactttgattttcttaagcggcttcattaacgactcaatggcatcggctagccgtaacggtggcgtggtcgcggttagaaccgttgaggctaagacaatcaaaataaaccgggcgagaatcacgagggcctggttgatccccccactagtgatcgccatcaagccccagtgccagtaaacgtggccccccgatgaaaagaggacctggatagcaattgtcagcccgattacccacagcagcggtttaagccccgcccaatacattttcagtggaacctttgaaagcccaatcatggcgcctagcatcgccaccaagagtaggtaggttaacgggcccttcgcaaagaaaataatgaccacgtaccaaaaacaggtcactaactttaagcgcggatccaagcggtgcaagacggagtcgacggggacaaagctcccaaacaagacgcggctattcatcattgtcagcaccccctaactgcgtggccagtcgatcggctagttggtttaacgagagcggcgcccctacttcaacccccacttgcttcagccgatgagcaaaccgaaccgactggggagcctgaaggtggtttttttgaagcaagtcagggtcggcaaacaggtcagccgggcgtccatcaaagactagactcccttggtttaacaccaacacctgttgagccaaacgagctacctggtccatttggtgggtgatcatcagaaccgtcaccccctgttggtgcagcttttccactagggttaagagctcctcttgaccagccggatcaagccccgcggtcggctcatcgaggatcaagacatcgggttccatcgctaagacccccgctaaggcgacccgccgcatctgcccccccgaaagctccaaggggctgtgttgcaaacggtctgcggggaagttaagggcggttaaggcacggttagccgcttgcttggcctcctcggcatccttccccaggttctgggggccaaaggcgacgtcttcgattacggtcggggcgaagagctgtttttccggaaattgaaaaacataccctacccggcggtggacgttaatcagatcctttttagcggtctgggaatcaatggtcaagtcaccaacctggatcgacccgctggtgggtaagatcagggcgtccaccatctgcatcagcgtcgacttaccgctcccggtgtgaccaataatggcggccgttgtcccgctggggatggtggcactcagatcaaccaccgcctgagttccctgctcatcagccccctggtaccggtagcctacttgcttgaacttaacttctgccatatccacttcaccatttcgtcttccgtactaatctcccttggaatggcgatcccccgggtcgccaacgcctccttgagggtcactaaaaaggtgggggccagttgatgggtttccatcaactgacgatcctgcatcaattctttggggtcgccatcgaccactaaccgtcccccgtcgatcataatcatctggtcagccaagcgggcctcttcggtgtcgtgagtaattgaaagaatggttaggtttccggtttggtgcagtcgttttagcagggtcatgatctgctcttttccttccggatcaagcattgccgttacttcatcaacgattaagaccttcgggtgcagggccaaggcgccggccagggccacccgctgcttttgtccccccgataactgggcgggctcccggtcagcaaaggctgtcatctcgacttgcgctagggcctgatcaacccgttcttgcatttcagtccggggaagacgctggttttcaagtccaaaggcaacgtcatcggctacggtggtcccaacaaattgattatctgggttttgaaagacaaaagccacccgttggtgaacggcagttaagttatccaccgttaccggtagcccatcgacggtaatctccccggccgccaacggcaacaagccatcaattaagcgggccaaggtggacttgccggagccgttgtgccccacgatcgctaaccaccgcccagccggaaccgagaagctaaccccctctagcgccggcgcctcactaccggggtaggtaaaggtggcgttttttacttcaatcatcgccaagcgtattttcctcctctggctttcagtatcttaaccattctagcaaattttcgcgtaaataaaaaatcacttacgaatggggcgcgccgtttccgaccttcaagctagactagaagcaatgcttcaccatcgtagcgctctataccaccaaacgtagtgattctttattacgtatttaacttaatctcgcttagacaagttccaagataaccatcttggcaccgtccccacgccgcggcatggtcttgaggatccgagtgtaaccaccgttacggtcagcgtacttcggtgcaatgtcctcaaacaggttttgcaaagcggattggatcttgatgtcatcgccatcttccttaacgtcagcaacgacgttccggacaaaggcagcagccttccggcgggaagcaaggtcgcccttcttggccagggtgatcatttgatccatggtcttgcgaacttccttcgcgcgtggttcagtggtggtgatagaaccattaacgatgaggctcgtcgtcaaatcacgtaataaagccttccgttgtgaactggtccgtcccaatttacggtaactcatgaagtgttccctcctttaatttaaataattaattaatcttcttggcgaaaaccaacgccaagttcagccaacttgagcttgatttcatccaatgacttcgtcccaaggttccgaaccttcatcatgtcggcttcggtccgttcagttaagtcctttacggtttggatgtcagcacgcttcaaacagttgtatgaacgtacagacaggtcaagttcttcgatggtcttgtcaagcaccttttcttggtgggtttcttcccgttcaaccatcacttgagttacttgtgcttcttcggtgaggttgacgaacatcgtcaggtgttcagtgaggatcttagcagcaagactgattgcttcggttggcgttaaggaaccattagtccaaacgtcaagggtcagcttatcgtagtcgttgctttgccccacccgggtgttttccaccgtgtagttaacacgttcgatcggggtgtagatggaatcaattggtaagacaccaattgccaagccctccatacgagtcttgttatcatcagcagatgagtaaccacgacccttatcagcggtcatcttaacgtgcaattcggcaccgtcggaaaccgtcgcaatgtgaaggtcagagttcaggatagtaacatcgccgtcaccttggatgtcggcagccgttacttcggccggacccttaacgtcaatttcaaggtccttagcgtcctcagaatcaatctttaaagcaacttgctttaagttcaagataatctgcgtaacgtcttccgtaaccccttgaaccgtgctgaattcatgcagaacaccatcaatttgaatgctggtgatggctgcccctggcagggatgccagcataacacgccgaagagagttacccagagtcgtcccgtaaccgcgttccaacggttctacgacaaacttaccgtagttgtctgtttcttcaactttgtggatgtttggtttttcaaattcgatcattctactctgttacccctttcaaaacgtgaatcgtattctgtaaaaggcacctggccgattaaaacatcgccgtagatgcacattaaacacgacgacgctttggaggacgagaaccgttgtgtggtactggagttacgtcccgaatggcagtaacttcaagaccagttgtttgaagtgcccggatggcagattcacgaccggaacctggccccttaacttcaacttcgacggtcttcataccgtgttccattgcttgcttagcagcggcttcagaagccatttgtgcagcaaatggagttgacttacgactacccttgaagccaaggaccccggcagaggaccaagcaactgcgttcccttgaacatcggtaatcataatcagagtgttgttgaacgttgagtggatgtgggcaacaccagtttcaatgttcttctttacccgacgcttacgcgtaccctttttggttgccatagattaactaacctccttttctaaataatgattacttcttcttgccggcaatggcaacggccttccccttacgagtccgggcgttgttcttcgtgtgttgaccacgaactggtaacccatgacggtgacgcatgccacggtaagagccgatttcttgaagacgcttgatgttgagggatacttcacggcgaaggtcaccttcaaccttgatttggtcaacttctgcacggatcttttcttcttgatccggcgttaagtcgcgaacccgaatgtcttcggaaaccccagcgttagccaggatcttttgtgcagtcgtgttcccaatcccaaaaatgtaagttaagccgattacgattcgcttgtcacgaggtaaatcgacacctgcgatacgagccattttgacacctccgtcctattctaaattacttgccttggcgttgcttgtgctttgggttaatgcagataaccataacccggccgcgacgcttaacaatcttgcagctatcgcacatccgttttactgatggtcgtactttcattgtaaataatcctcctaaaagatctttagactaagtcttatttgaagcggaaagtaatccggcccttggtcagatcatatggagacatttccacccgaacccggtccccaggtaaaatcttgatgtagtgcatccgaatcttaccggaaacgtgggccagaatttcaaccccattttccaattcaactttaaacattgcgttcggtaaggtttcagtaaccttaccctcgacttcgataacatcggcctttgccactgaatggttcctcctcgccgtctcgatttaatattactattacttacgtaaaaagggtggaagacaaccgtctcccacgaaaactagataaaccttgtgtattctaccacggtaagggtgaatgcgcaaggtaaacctcgcttacaggttcgtcagaacttccttaacggcttggtaaaccttatcgatatcttgttcgccatcgatggtgtataacacaccttgcttcttgtagaagtcaatcagtggcgtattcagtttaatgttgacgtctaaccggttcttgacagtttccggcttatcgtcgtcccgctggtagaagtcgtggcccccgcagacatcgcaagtgccttcaaccttcgtcgggttgtagagacggtggtatgttgtcccacagttccggcagataaaccgaccactaagtcgttcaactaaaacttccggacgaacgtgaatgttgatcacggcgtccagttggcgatcactgtccacaagcattgcgtttagtgcatcagcttgggcgaggttccgggggaacccgtccaacataaatccatccttggtatcgtcttgcgctaggcgctcttgaacgatcccgttggtaacctcatcaggaaccagttcacccttatcgatgaacttctttgcttcaacacccatcggcgtttggttcttgatggcagcccggaagatatccccggttgaaatgtgcgggatatcaaagtccttaacgattaattgggcctgggttcccttaccggcacccggcagccccattaacacaaggttcattgtgctcattgttgtgcctccttatggctactattcatggataaacccaatgtattcacgcttcatcgtcaacccgtttagttgccggacgacgtccaaggcgatttggacgacgatcagtaaactcgttcccccaagcccgattgattggcttaagttccaaacgttggaagcaatcaatggaatcagagaaatcaggcccaagaaaagggacccaacggtcgatagccgcatcaggagccccgagacaaagtcttgggtccccttccccggccaaacccccgaaatgtaggagccttgcttttgcaagttttcggctaatttttccgggttaacctgaacgaaggcgtagaagaaggtaaacacaacgatcaagaagatgtacagggttatcccgggacccgattgaaggttaaagatactggtcataacttggtaccaagtatccccggaatgattttgctgaaaggccattaagatcgtttgcggcgtcgaaataaccgaaccggcaaagataaccgggatcaccccggaaacgttaatctttaatggcaggtagctattggccggcgagacggtcgtccgccgggtgtactgaatcggcaaacgccgttcagcttgctgaacccacgttacaaaggcaacgatgatcagcaaagccaccacaaccagcgcaatgaacccgatgcccatccaaagggcactcccggattcgccagtgatttgatccgtccacaactgctggattgcgcttggcatctgggcgatgatcccggcaaagatcaacatggaaaccccgttcccaagtccccgctcggtaatcatgtcccccatccaggtcgcaaacattgttccagccgtcaggatgagaccaatcgtgaggtaggtcttcatccccggattattcaccagtttaatggtggagagggcgttgaacccggcggtgatcccgatcgactggacaaagcccaacacaatcgttaaccacctagtcgcctggtttaatttccgccgtccaacttcaccctgttttgaccattcaacgaacttcggcacgatgtccatttgtagcagttgaacgacaatttgggccgtaatgtacggcgaaacccccatcgcaaagagggagtagttttccaaacccccaccactaaaggtattaagaatagatgctaatcccgatgacgagagttgctgcaaggccgcagcgttaactcccggaacggtgatcgaagctcccaaccggtaaacaatcaacacgaacagggtaaagaagatccggtgtcgaatttctttgacccggaacgcgtttttgacggttgtgaacatttagatcacctcagtcgtaccaccggcagcttcaattgccttaacggctgaagcagagaacttgttagccttaacggtcagcttcttttcaagcttcccagttgccaaaaccttaacgccactcttaacgttcttgatcacgccgtttgcaaccagaacttctggcgtaacttcagcgccgtcttcgaattggttaagcgtcgtcagggaaacaagggcgaagtctttgtggtccatgctggtgaaaccacgctttggcttttgccggtagagaggcatttggcccccttcaaacccaagacgggtcttaccgtgcgccttttgacccttcgtcccacgaccagaagtgaaaccgtgaccggaagaaaggccacgacccttacgaagccgcttgaaacgtgagccagcaacaggctttaattcgtttaattgcattagttggcacctccttatttgattttgttttttacttaacttcctcgatggaaactaagtgcgcaaccttaaagattgcaccacgagtagccgcgttatctgggaggataacggagctgtgaagcttgcccagccccagagccttaacggtccggcgttgagtcggctgacggtgggtaacactgcggattaaagtaactttaactttagccatgtttggtgtcctcctattctgccaggtggtcaacggatgtgccgcgcagcttggaaacttcttcggcactcttcaaggccttgagaccttcaaaagtagcacgaacaacgttgatcggcgtgttggaacctaaccgctttgaggtaacgtcgttaacccctgcaagttccatcacgttacgaacggccccaccggcggtaaccccggaaccttcaacggctggctttaacatgatcttcccaccgccgtaagtaccgataacttcgtgcggaatggtcgttccaacggttggaaccttgatcaggttcttttgagcggctgcagaagccttgcggattgcttccggaacttcttgggccttcccagtaccgaagccgacgtggccattgtggtcaccgacaaccacgagggctgcaaagcggagacgacgaccacccttaacaaccttagtaatccggttgatggaaacaacttgatcgtcaagatccaacttagctggatcaatgtatgatgatgatgccattacgggtaattcctccctttccttagaattgaagcccgttttcacgagcggcttctgctaaagcttgtacccgaccatggtaaaggtaacccccacggtcaaacacaacagtggtaacgttcttttcaaccccacgcttagcgatcagggcaccaacaccggcagcttgttcggtcttagtcttaccacttacttcagtatcttgggttgaggcacttgcgagcgtcacaccctttacgtcatcaattaattgagcgtaaatgtttttgttagaacggtaaacacttaaacgtgggcgctctgcagtaccagagatcttaccgcgaacgcgcatgtgacggcgttgacggatcttgttcttgtctggtttagaaatcacaactgtcacctcttatttttagattagtttaacttgctggttgtaacctatgattacttaccagtcttaccttccttgcggacgatgtgttcgttttcgtaacgaatacccttacccttgtatggttcaggtgaacgaacggcacgaacttcagcagcgaagtcaccgacttcttgcttgtcaatcccactgatttcaatcgtggtgttgtctggaacagcaatttccacttcagcaggcttcgtcatttcaactgggttagagtaaccaacagtcaagatcaacttgtcacccttgaattgggcacggtacccaaccccgacgagcttcaaggtcttcttgaatccattaacgaccccttcaaccatgttgttaacgttggcgcgggtagtcccgtgcagggcacggaccttgttatcttcgccagaacgttcgaacttaaccacgttgccttcaacggacatcgtgatcagcggagaaatttcacgagaaagggtcccctttggtcccttaacagtaaccacgttaccttcttgagaaacttcaacgcctgctggcaaatcaatttccttgtaaccaatacgactcatgcgtacacctcctttgttagtttatttattaccaaatgtaggcaacgacttcgccgccgaccttcttagcacgggcaaccttatcagtaaccacgccgttggacgtagaaatgatggcaatccctaagccgtttaagaccttcggcacagcgtctgccttaacgtaggagcgaagacccggcttggaaatccgctttaaaccggaaataacgcgttcgccgtcttggccgtacttcaagaatacgcggatgatgccttgcttgttgtcttcaacgtattcaacatcgcggatgaaaccttcttgcttcaagatttcggcgatgtccttcttcatcttggatgcaggtgcttcaactgaatcgtggtgtgccatgttggcattgcggatccgagttaagaaatctgcgattggatcactcatagacatcgatgtttttcctccttttgtcggtgatttgtttaccaactagccttcttcataccaggaatctgtcccttgtgggcaaggtcacgtaagcaaatccggcagaggtggaacttacggtaaacggagtgtgggcggccacaacgttcgcaacgcgtgtattcttgcgttgagaacttggccggacgttcgctcttagcgatcattgattttttagccaattttgtaacctcctaattacttagcaaatggcatccctaattgggccagtaattcgtgagcttcttcgtcactgttagcagtcgtaacgatgacgatgtccaaaccacgaacacggttaacgttatcgtaatcgatttctgggaagatcagttgttcccgaacacccaacgtgtagttaccacgaccatcaaaggccttgttggaaaccccacggaagtcacgaacccgtggcaaggaaacgttaactaacttgtccaagaagtcgtacatccgcgtgccccgcagagtaaccttggcaccgatagccatcccttcacgaagacggaagccggcgatggacttcttggccttagtgatcagtggcttttgaccggagataagcccaagttcttcaacggcttcgtcaaggttcttggagttttgcgttgcgtccccaacccccatgttcaagacgatcttttcgagcttgggagcagccataactgaagagtaatcaaacttttcaatcaaagatgggcgaacttcgttttcgtacttagcttttaaacggttttccataagaagattgttcctcctttcgctaatgattagtcgatttgcttgccagacttcttggcaacccgaaccttcttgccgtcaacgacttcaaagccaacccgagttggttcgttcgttgatgggtcaagcagcatcacgtttgaagcgttaatcggtgcttcagtgtcgatgatcccgccgttagggttcatgttacttggcttttggtgtttcttgatcttgttaacaccttcaacgatcacccggttttccttggcgaaggtcttcttgatcgtaccttcttgacccttgtccttaccggtgatgacgcgaactttgtcacctgtctttaaaaacatgtggtagtgcacctccttatttttgggtaatctttacagaacttctggggccagtgagatgatcttcatgtagtcatcgtcacgtaactcacgagcgattgggccaaaaatacgggtaccctttgggctcttgtcgttgttgatcaaaacggctgcgttttcatcaaacttgatgtaggaaccatccttacggtgcagaccatgcttagtccgtacgacaacggccttcacaacgtcaccctttttgacaacgccacctggtgttgcttgttttacagtagcaacaataatgtcaccaatattaccggtcttaacacgggaaccacccaaaatcttgatgaccaggatttcgcgggcaccggagttatctgcgaccttcaaccgactttcttgttgaatcacggttagtgtcctccttccgtctataagtaagaattagaatacgaatttaaggtttgttgattataagataacggccttttctacgaccttaacaagccggaaacgcttcttagcagacagcggccgcgtttccatgatttgaacagtatcaccaacgtgggcttcgttgttagcgtcgtgagcgtagtacttcttggagtacttaacccgcttgccgtagatcggcgcgctcttgtaggtgtcaattacgaccgtgatcgtcttgtccatcttgtcagaaacaacgcgaccttggtacaccttacgtgcattacgttcgtcactcatgcgtaatcctccttttcgtattctagttgtttaattcttgttggcgaagaaccgtcttaacccgtgcgatgttcttgcgaacagtcttaaggcttgcagtgttttccaactggccggttgctaattggaaacgtaagttaaacaattgttccttcaattccttctcacggttcagcaattgctcagtggttaatccattcagttcttgtacgtaatctttagtcttcattagattgtccacctacttcctcacgcttaacgatcttagtgcgaactggcaacttgtttccggcaagacgaagggcttcacgggcaacttcttcaggaaccccagcaacttcgaacatcaccttcatacgcttaacaggggctacccaaccttcaggagcacccttaccgttacccatccgggtaccaacacccttactagtgtaagaaaggtgtgggaagatcttgatccaaaccttaccaccacgcttcatgtagcgcgtcatggcaatacgagcggcttcgatctgccggttagaaatccagtgagaatcgagagcttgcagaccgaattcaccaaaagtaacggtcttaccacccttggcttccccacgcatcttaccgcgttgaaccttacggtgctttactcgctttggtactagcatgttttagttccctcccttagcttcgttgttcttcttagctgggagaacttcaccacggtagatccaggtcttgatccccagaaccccgtaggtagtgtgagcttcgtcccaggagtagtcgatatctgcgcgaagcgtgtgcaaaggaacagtcccatcagagtaggattcgatccgagacatgtcggcaccgttcaaacggccggcaacttgaatcttgatccccttggcaccggcacgcatagtacgttgcatagcaccacgcatcgcacgacggaatgcaatccggttttcaagttgttcagcaacactttcaccaaccaggtgtgcatcaaggtctggcttcttaatttcaaccacgttgatgtgaacccgcttgttggtcaggttgttaagttccttgcgaagtgcttcaacttctgaaccccccttaccaataaccatccctggcttggcagtgtgaattgatacgtttacgcggttagcagcacgttcaatttccacggttgatacagaggcgtcagcaagtcgcttttcgatgtatttacggatccgaaggtcttcgttcaggtaagcggcgtagttcttatctgcgtaccacttagcagtccagtcgcgaatgaccccaacacggaaaccattaggattaatcttttgacccactattcattcctcctacttttctgcaacaaccactgtgatgtgactggtccgcttgttaattggagaagcagaacccttggcgcgtggacggaaccgctttaaggttggtccttcgttagcaaaggcttcgcttacaaccaaggatgcttggtccaggtcaaagttgttttcagcgtttgcaacagcagatttcaaaactttttcgacgtctgaagcagccccgtttggagtgaacttcagaatagcaaatgcttcggcaacggacttgttacggatggtgtcaagcaccaggcgtaccttgcgagatgatacacggaccatcttagcagttgccttagctgaagtaacgttttcagccattaatcaattccctcctttacttacgaccagtcttcttgtcatcggcagcgtgaccacggaaagtccgcgttggtacgaattcaccaagcttgtgacctaccatgtcttcttgtacgtaaactggcacgtgcttccgaccatcatatactgcgaacgtgtatccgataaagctcgggaagatcgtggaccgacgtgaccaggtcttaatgacggtcttcttgtcgctatctgcttgagcttcaaccttctttaataaagaagcatctgcaaaaggtcccttctttaaactacgacccatttttgtacctcctctcgggtatttgacgatttatgagtgattaacgcgtgtgtggaccacgcttacgcccacgaacaatgaacttgttggaacgagccttgtgtgaacgagtcttcttaccaacagtcttcttaccccatggggagagtggagatggtaaaccaactggagccttaccttcaccaccaccatgtgggtgatcgttagggttcataacagaaccacgaacgtgaggacgttgaccagcgtaacgggaacgaccagccttacccttaacgagcagaccgtgttcatcgttaccgatcgaaccaatcgttgcccggcaggcagccaggatcatccgaacttcaccagaagaaagacgtaccagaacgtacttttcttccttaccaagaagttgagcagaagtaccggcagaacgggtcaattgaccacccttacccggcttaagttcgatgttgtgaataacagtaccaactggaatgttcttcagcggtaacgtgttaccaaccttgatatctgcatccggaccagattgaacagtcatcccaaccttgagacccttcggtgcaaggatgtaagacttagtcccgtcagcgtaaccaagcaatgcgatgttagcagttcggttcgggtcatattcaatggccttaacagttgctggaacatcatccttgatccgcttgaagtcgataatccggtattgacgcttcgtaccaccaccacggtgacgaacggtcatcttaccagcgttgttacgaccagcggtgtgcttgagcggagccaataacgacttttccggcgtcgtcttcgtgatttccgcgaagtcgtaaccgttcatgttacggcgtccgttagtggtgcctttgtatttgcgaattcccactgtgttttcctcctatccgttagatttattcgttatcgtcgccgaataacttgatttcgttggagtcagcagaaagctgaacgatcgccttacgacggcgcttcgtgtagccgacgtaacggccttggcgcttttgctttcccttaacgttcatgatgttaaccttcacaaccttaacgtcgaagatttcttcaacggcgttcttgacttgcgtcttagttgctcgtaaatcaacgtcgaacgtgtaacgcttgttgtccatggcagccgtggaggcttccgtaattacaggacgtaaaatgatatcgcgtgcttccattatgcgagcacctcctctacttgagaaagagctgactgggtaatgatgatcttttgggcgttaacgacgttcaagatgttcacaccagctggcgtcacaaccgtcgtcttcggcaggttgcgtgctgataattgagcgttcttgtcttcgtcagtaaccacaactaagaccttttcgctaaccttgaggttgttcattacgccagcgaattccttcgtctttggtgcgtcaaagttcaaaccatcaacaacaacgaacttgtcgttggcaaccttttgggaaagggctgacttgatggctaattgacgaaccttacgtggtaatgcgtagttgtaggaacgaggggttgggccaaagacgatcccaccgccacggaattgaggtgcgcggatggaaccttgacgggcacgaccagtacccttttgacgccaaggcttcttcccaccaccgcgaactgcggaacggttcttaactgcgtgagtcccttgacgcagggaagcacgttggcgaagaatcgcatcgaattcagcggattcgtttgcttcaacagcaaatacgctgtcgttcagttcaacagtgccgttttggctaccgtcttgcttgaataatgcaacactagtcattgattacttcctcctttcttacttgttggattgcttgctaaggctcttcttagtgttagccttaacggagttcttgatcgtaacaaaggacttgttggcaccaggaacgttacccttgattaagagaacgttgttttcagtgtcgaccttaacgatccgcaggtgttgcacagtccgggtgttgttacccatccgacctggcagcttcttacccttgaacacgtggttgatgatggcaccaagtgaacctgggcgacggtggtaacgagaaccgtgcgccattggcccacgccgttgaccatccttgtggatgttaccttggtaaccatgacccttggtggtaccagtaacgtcgaccgtttcgccttctgcgaaaatgtcggctgctaccttatccccaactttgatgtcgtctcctaattcagcgtcgcggatttcaccgatgaagcgcttaggagtcgtgttagcctttgctgcatgaccttgttcgggcttgttgctcagaacttcgcgcttgtcgtcgaacccgagttgaacggcactgtaaccgtcattttcaagggtcttaacttgcataacaacgtttggcgttacgtcaataacagtaactggaaccaattcaccgttgtcagtgaagacttgagtcatcccgaccttcttgcctaagattcctttggtcatgagtacacctccaatttaatttgatttttgtttgtttttagattttgaattaaagcttgatttcgatgtcaacaccacttggcagatcgagcttcatcagggcgtcaaccgtcttaggggttgggtcgatgatgtcgatcagacgcttgtgagtgcgcatttcgaattgttcccgtgacttcttgaacttgtgtggtgaacgaatcaccgtgtaaagagtccgttcagtaggtaacggaattgggcctgatacttgagcaccggtccgctttgcactttcaacaatcttgtctgctgattcatccaaaacgcggtgttcgtaagcctttaaacgaatacgaatcttttggtttgccattgtgttccctccttcgtcaaatttgaaattatgactagctccatggaaattaccgccacatcctgtggcaaagcggccgggtgtgtcgcaaccttccacttcatcgcctgcgtgctgaaatcctagcgagggccactctctgctcctcttttgttcaagcactttttctataatacaagaaaaagcctggtgtagcaaggattttctgggattaatttcaagaaagtggtttcgtcgtttttctttgtccttcgaccatgaaaaaagacgcttaatttttttcgacggcgctcttctccccttccttgatcgaaacactccctagcattccatacaaaaaacaggtgccagcagctgctagcacctgtttttttacgggtcaagttaattacttaccaccgttcttttcgatgatttcttcttggatggacttcggcacagctgagtagtggtcgaaggtcatcgtgaaggtaccacgtccttgggttgcggaacgaagggtcgttgcgtaaccgaacatttcggacagcggaacgaaggagtgaactaattgggcgttcccacgttcttccatcccgtcgatcgaaccacgacgagcggtaacgtgacccatcacgtcacccaggttatcttctggggcgacgatgtcaaccttcatgattggttcaaggataacggctccacccttaggagcggcgttacgtaatgctaaggaagcggcaaccttgaaggcagcttcagaggagtcgacttcgtggtaggaaccgtcgtaaagcttagcgtgaaggtcgaccaatgggtaaccggccagaacaccgttttccatcgcttccttcaacccttgttcaacggctgggatgtattcacgcggaacaaccccaccgacaatggcgtcttcgaattcgaagccggccccttcttccagcggcgtaaattcgatccatacgtccccgtattgacccttaccaccagattgacgaacaaacttcccttgggcggaaacttgcttagtgaaggcttcacggtaggaaacttgtggcttaccaaccgtaacttcggcgttgaattcacggcgaagacgttcaacgatgatgtccaagtgcagttcacccatcccggcgatcagagtttcaccagtttcagggttcgtttcagccttgaaagttgggtcttcttcagccaacttttgcagacccttgtccatcttgtcttggtcagccttggacttcggttcaacagaaacctggataactggttctgggaagtccatggattcaagttgcagtgggtggtctgggtcggtcaaggagtcaccagtggtggtgttcttcagaccgatggcagcggcgatatcaccagagaagacttctgagatttcgttttgttggttggagtgcatttgaagcagacgaccaatccgttcacgcttgcccttggttgcgttcagaacgtaagaaccagatttaagggaaccagtgtaaacccgcaggaaagtcagacgaccaacgaatgggtcagttgcgatcttgaaggccaaagcggcgaatggcttgtcatcgccggcagtcagttcaatagcgttaccttcctcgtcgtgagcaacgaatggcttaacatcaactggggatggcaggtaatccaagacggcatcaagcatcatttggatccccttatccttgtaggcagaacctgccattaccgggaagagttcttggtccagggttgcttgacggatggcagccttgatttcatcaacggagatttcggcaccttcaaggtacttttccatgatgtcgtcgtttacgtcagccagcgtttcgatcattgcgtcgtgacggctttcggcttcatccttcatgtcggctgggatttcaacggtgtcccagttttcgccgagcttgtcttcgtcgtagatgtaagcaaccatcttaaccaggtcgatcacaccggcgaattcgtcttcggcaccaattggcatttggattggaagcggcataacgttcaggcgttccttgatggtcttaacggaatagtcgaagttggcccccatcttgtccatcttgttagcgaagaccagccgcggaacgttgaagtcgtcggcttgacgccaaacggtttcagtttgtggttcaacaccggcttgggcgtcaagaacggttacggcaccgtcgagcacccggagggcacgttcaacttcgacagtgaagtccacgtgtcctggggtgtcgatgatgttgatccgggtatccttccaaacggccgtagtagcggcagaagtgatcgtgatcccacgttccttttcttcttccatccagtccatttgggaagccccatcgtgggtttcaccaatcttgtgaatcttaccggtgtagtacaaaatccgttcagtggcggtcgtcttcccggcatcgatgtgggccatgatcccaatgttacgggtcttttcaagagggtattcacgcttgttagccatcttaaaagtgatctccttccgtgtttgtgttgttatttttagaaaaaggggtgacgagtggagtttccgccgtcacccctcctgattgtaactagtttaagggctagtttcaaaccgcaatcttaccagcggtagtgtgcgaaggcccggttagcttcggccatccgcagggtgtcttccttcttcttgatggaagcaccagtgttgttggaagcatcgatgatttcgccagaaagacgttccaccatcgtgtgttccccacgaagacgtgcgtattgcacgagccaacgaagtgccaacgtccgttgacggtctgggcgaacttcgatcggcacttggtagttagaaccaccaatccggcgcgccttaacttcaagggccggcttgatgttttccattgcttgttcgaacacttcgatcgggtcgttaccagtttgttccttgatttggtcaagggcttggtagaggatcttagaagcggtcccgcgcttaccatcaagcatcaagtggttgatcaggctggtaaccagctttgagttgtaaattggatccggtaaaacttccggctttgctacatgtcccttacgtggcattgcttaatccctcctatataaagattacttcttcggcttcttagcaccgtacttggaacggctttgcatccggccgtcaacaccggcggtatcaagcgtcccacggatgatgtggtaacgaaccccaggaaggtccttaacacggcccccacggatcaggacaacggagtgttcctgaaggttgtggccaatccctggaatgtaagccgtcacttcgatcaggttagataaacgcacacgagcgtacttccgcagggcggagttaggcttctttggcgtcatcgtcccaacacgggtagcaaccccacgcttttgcggtgatgggttcttgatttcttccttcttaaaactgttgtatacaaagcccagggcaggtgactttgacttacccttgtggctcttgcggcccttacgaaccaattggttaatggtaggcataatttttccccttccttaatttaagtccacacatccaggcggttctttttttggaataaaaaaagggcgctggatgttatttagttttgtgctatcgctgcgcatgccgtctgcccaacgacagaccaatccgttgctcaaaaaagcacctttattaaattaacacgctctctgactaaagtcaacgacaactctgatcaaattcgtaacattgagtggttttgccgtacttaatgggcaggaggaactaattatggaacaactaatcgcctttttaaccggctcttgcctagcatcgttcatcgtcaccatgacccagcggcaccttctagaaatgggaccttcttccccccgttcgctttgtgatcactgtgcccaccccctagcctggtggcaattgattcccctcgtcggcttcgcccttcagttggggcggtgccggtggtgcaaaaaaaccatcgccccctggtccagtgtgtgcgaactaacttgcggaacgtggttagccctatacaccccccttgacttaaccgagtggttagcaagcctagtcctgttaactggcctgtcagccatggccactaccgactggtacgccgggtggatgaaccccctcgccctgactagcctactccccctccccttaattgcgttgtctcccctggggatagaacaacccgccctcttcttattagtggcgggattactctcattgatcaccttacttagccacggactgggcctaggtgatcttgaatggctcttagtcgtcttacttttagctgggtggcagtgctattggcaaaccctgctaattggctgcggcctagccttaacctcccctaagttatggcaccgccaaccactcccctttttgccctacctttctaccgggctgctcgtttcattgttgatctagaaaacgagtggaaattaagtttccaacgggaatgactaaatttagcagtagggtagttggtccgtggcgttctttagccgtacttaacctccgggtcttttgttttctttgggtatgtttttataaattctccgggaattcaaaaggggactggaaaaacacgtttcctcagccccctagttataattaatgactaacctcgtcattttcttcggccaccaattcgacggtaaagaggcggacgtccctttgcacgacggcttcaattaactggaaaagtaacaaaatccacgaaaacgcgatcccaaaggccagcatttcaaaagcggttaaagaaaggtagcggacgaacttaaaagcgatgtaactaacggccaacacgccaccgatcacgtaagaaagggtcaagaaggtcttagtcatcattggcatcgtccaccgaaccactaccaccaaaattaacatggtgtaaaccatccacatggcgatgcgatcgtgaagaaggtgaaaacgtgggtcatttggaaacagcccgaccccacctaggcaagctgccattaagttaagtagccagcgggtcacttgaacccgccagccggggtacttcttggacaggttgacaaacaaatagtcaatcaaggtcaacatcagcattgccgaaaagatcagggtaatattaaactgccagctattcgacgagtttgccgtccccaggaagctaaaattatgacgccaccaatccttattggaattagttaacatcgagaagaacacccccccaataatcatgaatgtcattaggttagtaatcaccccgggagaaatcgtcatggccaggttgatcatgatgtaagtaaccatggcaatcaccaaaaaaatcagggcgccggccgtgtaaatgtcaaaaacggccccgtgaaaaagcgaccccaccaaccaggctcccgccaccaacgaaaaggcggtaatcgtcccgcaagcaaccataatgctgatcatagcccgccaagaaaattcctgcgcccggccacgatggtgacgtttttggctaatgaaggtgctggcaaaggccaataacccgcttaaagtagcaaggtacaggctagccgacgccaccgaatcaccccccaccagtggcaagaggtggtagccttggttaatcatatcggcgtaaaacaacaacgtcagtactaaggcggggccaaagtaccaccggagcttgatttggggtaaactgtcacccaaccgcagtgggcgaatcaccaactggttgccttccacccacattgctaagggctcgccatctttaatttctaactggtcccgggcgaccttgggaacttccacgcgataattcttcaatccacttctccttgttaactgattttatacttactagattatcatcaatttagaccactaccacactctcactaaaatttaattataaagtttgacatgcgccactccctcccctagactagggcaatacacttaaactacgggggactcacgatgagaaaaccaatgattgctttaccagccgatacctataccgaggcaactagcatcatcaacttacgaaacgccgcttttgcgcccgatccggccattaaagcgatcaccaagtcgggagggcttccgatcgtcttgccaacagtggctgccgaaaacgccgcctcttacgttgacctgttcgacgggctcttgttgctcggcggttttgacgttgaccccaccttttacggtcaggagccccactttgaattaggggaaaccttccgtaaacgggacctctttgaaatcgccctgcttaaggcgaccattgaggccggcaaaccgatcatgggaatctgccgggggttgcaattgattaacgctgggctcggcggcaccctttatcaagatctttctgaagacccgaccgcccgccttaagcaccatcagttagccccaggaaacctccccacccaccacgttaatgtccacgagggctcccagcttcaaaaactggttggtaatcgaatctacatcaactctcgccaccaccagtcaattcatgaggtggcgccgggactcaaagtcgttgcccgcgctgacgacggggtgatcgaagcggtcgaatccatcgattctaatcaaattctcgccgttcagtggcaccccgaaaacatgtttaaacacacaccggaatcacaagtcattttcaaggacctgattgaccgcgctagccaacaaatctaaattcaacatcaaaaaggacccgccaaaccagcttggtttgacgggtcctttttattcaatcaagcgcttagtcttgatcctttagttgttcttccatttcgcggatggaggtaatggccccatcggttgtgccagtgttgacactgacttccttgggcttgatgttgcggtaagcacccatccccgttccggctggaatgatcttcccgataataacgttttccttgagccccaccagcgggtcgttcttgccccggatggcggcgtcggtaaggacacgcgtcgtttcttggaaggaagcggccgaaaggaaactgttagtttcaagggctgccttagtgatcccgaggataactggccgggcagtggccggaattcccccggaaatcaaggtttggtagttagcatcgcggaattggctgatgtccaacagttcacccggtaaaacatcagtatcaccaggatccatcacccgcaccttacgcatcatttggcgaatcatgatttcaacgtgcttgtcgagcaggtcaatcccctgcatacggtaaacattttgcacttcggagagcaggtaggtttccgtggacaagacgtcgcgaacccgaatcatttcctttggatcaattgacccttcgttgatggcgcgaccacggtgaatatcatcaccttcggccacccgcatccgggccgtgatcggcagggtgtaagtccgcgtgtcggtttcacccttgatcgtaacgtccttagtttgttcagctgggttttcttcgatggaaaccacctgaccagtaacttcggagatcgtggccttccctttcgggttccgtgattccacaatttcttggatacgcggaagcccttgggtgatgtcgtcgttaccggccaccccaccggtgtggaagttccgcagcgtcagctgggtccctggttcaccgattgactgtgtggccaccgtcccgattgcttccccggcttccacttggtccccggtagcggcgttgcgtccgtaacaacgttcacaaaccccgtgttcggtgttgcaagtgaaggcggagcgaatcgttaccttttgaacgcccgcatcgataatcttttgcgccatctcttcgttcaagaggacgtttttaccgacgatcttttccccggtttccggattaaagacggacttcatcgtgtaacgacccaaaatccggtcgtataacggttcgatcatttcgttcccgttagtgatggcggtcacttccagaccacggtcggtgccacagtccttttcgcgaacgatcacatcttgggccacgtcaaccagccgccgggtcaagtaaccagagttggcagtcttcaaggccgtgtcggtcatccccttccgtgccccgtgggaagagataaacatttccaagacggaaaggccttcccggaagttagaaaggatcggcagttccatgatcttcccggatggggaagccatcaacccacgcattccggccagctgggtaaagttggagatgttcccccgggccccagagtcggacatcatgttgattgggttgtggatatcaatgtgttcgatcagcttgttttgaacttcatccttggcatcgttccagatcccaatgacccgttcgtaacgttcgttatcggtgatcaaaccacggcggaattgcttcgtaaccagggccacttgcttgtgcgccttttcgatgatttccggcttttcctttaagtcggtcacgtcggcgatcccgacggttaacccggaaatcgtggattcgtagtaaccaaggtccttgatccggtcaagaagttgggaggtgacggtcaccttgtagatcttgtaaacatcggcaatgatgtccgacaagaagcccttcttaaacggcggcaccagcggcgcgttttctaagtaggcgtgaatgtcttcaccaggttccaagaagtacttgtccggaaccccgttttgcaggttgtcggcggtcggttcgttaatgtaagtgtaatcttcaggcatgatgttgttgaagagcaacttcccaaccgaggtcaccatgatcttttggcgttgttcagcggtgaacggcttcttgtcaaaggaagaagtcagcaccccaacccgggtttgtaaggccacgtaaccgttacggtaggccatccgggcttcgttggtatccttaaagatcataccttccccttcacgggccttgtcttcagtcgtcatgtagtagttaccgataaccatatcctgggatggggccacgattggttccccgtcacgaggtgaaaggatgtggtgagcggctaacattaacagacgcgcttcggcctgggcttcatcggacagtggtacgtggatggccatctggtccccgtcgaagtcggcgttgtaagcggcacaaaccagtgggtgcaaacgcatggccttcccggaaaccaggattggttcgaaggcttggatccctaaccggtgcagggtaggggcgcggttcaagagaacagggtgttccttgatcacgtcttctaagacatcgaagaccttttcgtcacgcttgtcgatcatccgcttggctgccttaacgttggtagccaggttccgcttggtcagttcgtgaatgataaatggcttgaagagttccatcgccattggaaccggcaaccccatttggttcatcttcatggatggaccaacatcgataacggaacgaccagagtagtcgacccgcttcccgagcaggttttgacggaaccgtccttgcttccccttaagtaagtgggacaaggacttgagcggacggttaccaggaccggcaaccggacggccacggcgaccgttatcaatcagggcgtcaacggcttcttggagcatccgcttttcgttttgaacgatgatgcccggagcgtttaattctaacaggcgcttcaaccggttgttccggttaatgacccgccggtacaagtcgttcaagtcggaagtggcaaagcggccaccttccagttgaaccatcggccgtaagtcaggtggcataaccggaattacgtccatcaccatccattcaggcttgttcccggacttgagaaaggcttccaagatatccaggcgccgaaccgcgcgggtccgcttttgcccagttgcttcctttaagaccgcctttaattcggttgcttccttggccaggtctacgtcggccagtagcttttggatcgcctcggcccccatctcagcggtgaaacggttgccatattcttccttgagttcccggtaacgtggttcggaaagcaattgcttcttttccagtcccgtgtccccggcgtctaaaacgacgtaagaagcaaagtagattacttcttccagttcccgtgggctcatgtccaagaccagccccatccggcttggaatccccttgaagtaccagatgtgagaagcaggggcagccagttcaatgtgacccatccgttcccggcggaccttggcagaggttacttcaaccccacaacgctcacagacccgcttgttgtaacgcgcccgcttgtagcgaccacaggcacattcaaagtccttggtcgggccgaagattcgttcatcaaagagaccgtctttttctggctttaaagttcggtagttgatcgtttccggcttggtgacctcaccgtaagaccaactccggatcttcattggggaagccagaccgatctccatactttcaaaattattgacgtcaatcaaaggataatcctccttatttaatccctaagtggcgaacctaatcttgcttggcttcgtcttgggcgctcgtcgcttgcgctggttgttcttccagcgtttcgtggccacggcgggccagtttccgaacgtcagcaacgtcttcatccatgctcttaagctggatttcttcgtgcttgtcatctaagaccttcatgtctaacccaagggattgcaattccttaaccagcacacggaaggattccggtacccctggctttggaatttggtccccgtcaatgatggcttggtaagtatttacccggccgaccgtatcgtcagacttgtaagtcaagatttcttgcagggtgtaagcagccccgtatgcttccagggcccaaacttccatttcaccgaaccgctgtcccccaaattgggccttcccaccaagtggttgttgggtaaccagtgagtatggaccagtcgaacgggcgtggatcttgtcgtcaaccatgtgggccagcttcaggtagtgcatgaccccaacggcaacccgttgttcaaatggttccccggtccgaccatcgtaaaggatcgtcttcccatcggacggtaagccggcttccttaacggcatcccaaacgtcttggtcgttggcaccatcaaagactggcgtggcaatgtggatccccagctcgcgagcagccatccccaagtgaagttcgatcacctgaccgatgttcatacgggacggcacacccattggtgacagcataatgtcaattggggtcccatctggcatgtacggcatgtcttcttctggaacgacgatcgaaaccgtccccttgttcccgtgacgaccggacatcttgtccccgacttggatcttccgcttctgggcgatgtaaacacggaccatcttgttaacccctggggctaattcgtcaccgttttctcgggtaaagaccttcacgtcttggatgatcccgccaccgccgtgtggcaccctgagggaggtatcacggacttcgcgtgacttttcaccaaagatggcgtgtaagagccgttcttcggcggatagttcggtaaccccctttggcgttactttaccaaccaaaatgtcaccatcgtggacttcggcccctacccggatcaccccggattcatcaaggtccttgcgggcgtcttcactgacgtttggaatttcgcgcgtcatttcttctggtccgagcttagtttcgcgggcttcggattcgtaagattcgatgtggatcgaagtgtaaacgtcgtctttaaccaggcgttcgttaatggcgatggcatcttcgaagttgtaaccttgccaagtcatgaaggcgatcagtgggttttgaccaagggctaattccccttgttccattgatggtccgtcggctaagacgtcatcagcgtcaacccattcgccaaccttaacaattggccgttggttgtagttcttaccaccgttagagcggcggaacttcatcagcttgtaagtgtctaacgttccgtcttcttggcgtacccgtacttcgcgggcgtcaacgtattcaacggtcccactgttcttagcgatcaaagcgaccccggagtcgtgggcggccttgtattcaatcccggtcccgatcaacggagcgtgtgggttaatcaacggaacggcttgccgttgcatgttggcacccatcaaggcccggttggagtcgtcgttttccaagaacggaatacatgcagaggcaacggaaaccacttgctttggcgaaacgtccatgtagtcgacgttttctggcgccgtttcgatgtagtcttccttatcacggcacatgatttcgtcgtgaacaaaggaaccatcttcgttcagtggcgtgttggcctgggcgatgatgaagttatcttcttcgtcggccgtcaggtagtcgatccggtcggttaccttgtggtcggcccatgagacacgacggtacggcgtttcgataaagccgtatgcgttcacccgggcgtaagaggacagcgagttgatcaacccgatgttcggtccttccggcgtttcgatagggcacatccggccgtagtgggtatagtgaacgtcccggacttcataaccggcccggtcacgcgtcaaaccacccggtcccagggcggacagacgccgcttgtgggtcaattcacccagtgggttggtctggtccatgaactgggaaagttgggaggaaccaaagaattccttaattgaagccacgactgggcgaatgttgatcagttgttgtggcgttacggtgttgatgtcttggattgacatccgttcgcgaaccacccgttccatccgggcgagcccgatccggaattggttttgcaacagttccccaacggaacgaatccgccggttacccaagtggtcgatgtcatcggtagtcccgatcccttcttgtaagttcaagaagtagttgatcgaagccaggatgtcggctggttggatgtgctttaagtccaaggagatgtgaccgttagataccaccggcaccttgcgttcagggtctttcttggagtaaaccatgatcttttgcagttgaaccggcgcggttaccactgcttcatcggatggcgtgtaggtgatcatcttaaagtcgtcttgttccagaaccggttcgagttcctttaagacttccttagtgatgacgtccccgtccttggcgataatttcaccggtttctgggttggccagggtttcagccagggtcaggcctaacaaacggtacttcatttgcagcttcttgttagtcttgtaacgaccaactggcgccatgtcgtagcgctttggatcaaagaagcgggtcgtcaaaagggaccgtgcggagtcggccgtcttcggttcacctggacggagccgttcgtagatatcctttaaggattcttcaacccgggagtcttccggttccttgtgtaggtccttttcaatggtggcgttcagggattctgattcgctccccaacatgtcccaaatttcgtcatcggaaccaaaaccaagggcccgaactaattccgtaattggtagcttacgggtccggtcgatacggacgtaggaaattcccttagcgtcggtttcgtattctagccaagccccccggttcgggatgaagttggcaccgtagcttgggcgcccattcttgtcggcttcttcgttgtagtaaacccctggggaacgaactaattgggatacgataacccgttcggccccgttgatgatgaaggtcccttggtccgtcatcagtgggaagtcaccaaagaagacgtcttgggacttgatttcgcccgtttcgtggttggtcaggcgtaacgttacgtgcagtggtgctgagtagtttgcgtcatgttcacgcgcttcagcgaccgtgtactttggttccaacaattggtagtcaacgaattccaaggatagcttcccctggaaatcatcgatcggcataatgtcgtcaaacatttcccgcaaacccttgtccataaaccaattgtaagaatcggtttgaatctcgatcaagttaggcaggtccaagacttccttgattcgggagtaagaacgacgggtacggtgcttaccgtacttaactaagtgtccagccaaactattcacctctctagtttgataaacgggtccaggagcgcaatgttacatttcggttacaatttaaccaaaagtccatttttgggcaaaagaaaaccaaaagcaaccagatcggtgcctttggttttttataaagagcctgatggacaagagatcatgaggctcactgaactcacaattacatactcttgtatcatacaagctttcggtttgaatgtcaacggctatgcttgcttaacaaagccgtgcagaatgcagctcaagatgattcgttgccgttgttcttcgttgatggcccgaccaccgacctgttggaaggttccaaacagtggcgttaagctggcaataaagagttctgccgcttcttttggcaacaggtctggacgtaagttgacctctggcagcttgaagtattccgacaggggttccacgtagtccatcataaagatcatgtccaacttcaattgggagctagccgtaagcgaccggcgggcaaattgatattggctgtagacacttaacgggtggtacttcaagatgaccttggcaatttcccagagtcgctcctctgggtccatgtcttcttttctcatcaccttgttgatgtcttggcgtacctttccgcataaggccgtcaagacgtctaagtacaagacctctttatcactgaagtggtgataaagggctggttgagtaattccgatgtgtttggcaatgtcccgggttgacgttccgttgaagccattctccaagaataacttggtggccgttcgcaagatcgcttttcgggttttagctaattgttccgctcgcttcattagttttcccttcttaaactgcttagttccttatcattatgtgttcaccaataactaattgtacattgttccgcttaattatcaataattagtttaacttatcttttatttatttcgcaataaaagccgcccggcgggggcgcccttcccccgtcagctagcggcttaattgcataatcaacttgttaattttggagaactaggttccgggaagcgttgtcagaagttttgactttgaagctcaatttcccccgttgggcaccaatcgtcacttgatcaccggccgcaacttggccatcaatcatcgataaggagagcgggtcttccaccatcgtttgtaaggcccgccgtaatggccgcgccccgtattcagggttgtaccccttcgccgctactaactcaatggcagccggggtcagtttcaggctgatcttttgttccgccacccgctttaccaactgggcgctcaagagcttaaccacttggtgaatattttccttggtcaacgagtggaagatcacggtctcatcaatccggttcaagaactccggccggaagtgcaagcgcatctgttgcttgatggccgccgacatcgcttggtaattattttgaacgccagtcgccccgaagccgaccgtcttttcatcggccaactgggtcgcccccaagttggaggtcatgatcaaaatcgtgttccggaagtcaaccttacgtcccttggaatcggtcaaaaccccatcatctaagacctgtaacaggaggttaaagacatctgggtgggccttttccacctcatctaataagacgacggagtacgggtgttggcgaacctgttcggtcaactgtccaccttcgtcgtagccgacgtaacctggcgccgccccgactaaccggctggtcgaatagcgttccatgtactcggacatatcaatccggatcatgttgtcttcttggccaaacatcgcttcggctaacgccttagccagctcggtcttcccaaccccggttggtcctaagaacatgaaggaaccaatcggccggttcgggtcctttaagccgctgcgggcccggcgaattgcccgggcaatcgccgaaacggcttcgtcttggccgatcactcgtttgtgaagcaccctctccaggttaaccaagcgatcgctttccttcttttggagttgggttaacggcaccccggtccattcgttaactaccttggcaatgtcttcagccgtcacggtgtacaggaacttgccatcggcaaccaactgggcgtctcgttcccgctgttcttcgatttgtcgcttaaccgttagctcttcgtggcgtaagtcggccgcccggtcaaagtcttgctcggcaattgcgtcctctttttgtgcccggagttcctctaacttgaccgtcaagccattcttttggttccccttttcttcaccatcgatgcggaccattgccccggcctcatcgatcaggtcaatcgccttatccggtaagaaacggttggtaatgtaacgactcgacaagttaaccgccgccatcagcgcttcatcagtaatcttggcgtggtggtgtttttcatagcggggccgaattccctcgaggatttggcgggtctgctccttagttggctcttcaaccatgatcgtcgcaaaacgccgttctaaggccgcatcggtttcaacgtacttttggtactcgtccagggtagttgccccaatcaactggagttccccccgggccagggccggtttgagaatgttggaggcgtcaatcgccccctctgctcccccggcaccaatcatggtgtggatttcgtcaataaataagataattttgccgtcccggtaaacttcatcgatgacgtttttgatccgcccctcgaattcacccctgaatttggtaccggcaaccaaggtccccatatccaggaccaccaagcgcttttcggctagttcatcaggaacttcaccgttaactatccgttgggcaaggccctcgacaatcgccgtctttccgacccccggttcccctaacaggaccgggttattcttggcccgccgggcgaggatctgaatcgcccgcttgatttctttttcccgtccaattacggggtcaagcccttcttccctggccacctttgtcaaatcacggccgtacttatcaagggttggcgtagtcccttccccctcctccggttgggtattggattggttttgccggcggttgcgccgtccctcttgagaaacccccaaacgccgtaacaacatccggcgggcttgctttggttccacgtccaagttcaaaaggatccgcgaggaaaggatggtctcatctgacaacagggccaacaataggtgctcagtacccacacgtcttgcccccatttgttgggccaagcgggccgccagggccaaaatttcgcgtaactttggcgaattaggcaggtacgcatcgctagcggtgttttgcatggttccgtacccggtgtagcgttcaatctcttcacgcaggtcgtcactagtgacgttaaactggtgcaaaaccgtcgcagccacccccaccttttcgaggctcaaggccaagaggaggtgttccgtcccgacggcttggtgtttaaaaaagcgcgcctgttcctgggcaatccgcaagacgttattggcgcttggtgtgtatagattttcgttatccatttaaagctcgctttctggttagctttcatagcgtaaccgattcaagagcgacataaggatctgagcccgcaggccgttttcctccccccgggttccatggggagccaaggttgacttagcggtggccgctagcatgagatccccttcccgacggctaatcaacttctccttgtacagagtctggatgatggcaaaggcgtcacgttcattaatggccgccccgaccacatccatcatcatctcaatcacgtcgacgttatcaagtaggctgacccgctcaatgcggatgtagccaccaccgccccgcttgctacgaactaggtagccatttttaggggtgaagcgggttttaatcacgtaattaatctgtgagggaaccacatcgaagtggttggcaatttctgcgcgccgaatttcaatttgagcggagttaccgaggatttgctttaagtaatcctcaatcacgtccgagatacttttttcttccaagagtgttcacctcatccctgactaattttgaccttaattataccattcttttggttgagaaacccccacaaagctctttagaataaaaaaggcctccccgcagggcgaccttttttaacttaagttagcaaacaagcttattcgtgaacgaagtcaaccacgttccgaccaacgaccttattgtcctttaattcttggatcatgtcgttgatttcatccaacttccgcgtcttaacgatcggcttaacctttccttcagccccaaattggaagcattcagccaggtcttgacgagtcccaaccaaggaaccagccacgataatcccgtctagcaccgtcttagcgatgtttaattgcatgtcaccttgtggtaaggcaacggcaaccaacttcccgtctgggcgcagggagtcaacggcttggtcaaaggcggaagcgttaacggccgtaacaacggcagcgtgaaccccaccaaccttttcttggatttgcttgtcaacgtcaccatcatgacggttgatcaagacttcagcaccgttttccttggcagcttgaagcttgtcttcgttcccgtcaacggcaaccacgtgagcaccaaagacgttgtgagcaaattggatccccaagttcccgagaccaccggcaccaacgattgatacccattggcctggcttgatgccagcaaccttgagggccttgtacatggtaaccccggcacaagtcagcgaagtagcttcgactgggtccaggccttccggaaccttaactgcgtaatcagcaggaacgatacattgttgtgccatggccccatcggcggtgtaaccggcgttgatgacttcgcgacagaaggtttcccgaccagttaagcagtattcacagtggccacagcccttgaagaaccaagcgatcgaaacccggtcgcccaccttcagggaggtaacaccaggagcaaccttgcttacgcggccaacaccttcgtgaccgataatcgtgcctggcttttctccaaagtcgccggctgcgacgtgtaagtcagtgtggcaaaggccacagtattcaacgtcaacgagggcttcacccggcttgaggtcgcgaagttggacatctttgaccgtaacaaatccatctacgggatcattaataacagctgccttcataaagtctatctcctttgctaattccgtataacttttcatttacggctctcattttatcaaaaaagatgtgacttttaaaggtgaaatttagcacagaattgaaaattaagtttttattcataataaattaataatgtaaatacccaggcaaaaaggatttaatcaatgtaagcgcttttagactttatttcacaaagtgtctaataatacaaacttgcaaccatgtcgttggaccggctacaatggataaataaatgcattcaagctttttaggaggtctgtttttatgaagaaagtaatcatcgatccgggcttttgggagctatttccagaagcacaaattaacatcatgacgatcaaggggtttgataaccacgacacccccgaaacccaccagcaacgggccgatctgttagcccaagcggtcaaggaatccgctaagttcaccgccgccgacccgttccgtgacaacccggtcatcgcgcagtggcgggatgcgtactcccaattcaagaagcgtaagggtgcccgcgcatccatcgaagccctgttgaagcgggcgaaccaaggccacgtttttgaaccaaccatccctttggttgacctttacaacagcgtttccctgagctacggggttccggttgggattgaagaccttgataagatcgaaggcgatctccacttgggacttgctaagggtggcgaaggcttcttcccgttgggggctgaagaagacgacccggcccgcgaaggcgaagttatctactacgacaacggcggggccgtttgccgctcgctcaactggcgggaagcggaacggaccatgctgaccgaggccacgactaacggggtagcggtaatggaatccgttaacgccgaacaagccgtccgggcaaccgaagcaatggccgaactgagtaaactggtggccgacttctttaaggttacccccagcgaacagttcattttaactaaggatcaccccgaagtgacggtggattaaagcaagtagctggcaaattaaaaaccgaccagttcgcgattttgcgaactggccggtttttttataggcttagttttgccaacacccgttttcggctgttgtaccaatcgtgaaccactagttccacctggtcgaccaccagcgtcccaaagttgaggttcgctaaagttgccaaggtagcgaggtcctggtgcggatcaatcaggggcgcttgttggcgggcgacggtcacgtgagcagtcgtctgctggtagcgctcctttaattgaagcttgtgcacccctaagtggtggcggaccgcttggcgcaagtccgctagccccggttggtaaaagccagccgctatgaccgcgctgccgctcgcaaccagcccccggaaggccacttcaaaggggtgccccccttccaccgctaacttgacggcggaaacgtaggcagcctcttcttctggagtcagggcaaagtctggcgtcgcccggatcaaatcaatcacggttacgtgcatatcttgagcaggatagtagtattgcccgggctcaacctcacgcaacttccccagggcgaaactaatgttacggctaacgtgagccggcagggtaaagattaggcttaacccccgccggcgatcggctgcccggtcacttaaccagggatcaatgtcgccccccgccagcaatagttccgtaccccgttgattaattgcttggtacttagcagttaggtccattttaggcactcctttttggatctatgataccactattctggaagctctttgatcacccgggccggcaccccggccacaattgtgttagcggggacgtctttagtcaccaccgcacccgcggccaccaccacgttatcaccaatcgtcacccccggcaagatcgttgctttcccgccgatccaaacgtcgttgccgatcgtcaccggtaaggccgtggcgtgataatggcggcgccctgaccaagaggcggacaacgtagtggactaagacggccccaaacaaaaggtcggaaacgagccgggtgcaaaacagggcgagaatcatcggtagagctaagtgaatgtaaccctgcttaaagatttcgtaggcaaaggacaccaccgtgacccaaaaggccgatgaaatcagcgccggccagccccagttcttgtagtgcagggttaaaaagcccagttcactcccggccacggcggctaacacctccccaatcacggccgtccccgggagccggagaatggcaattgctagtggtccggccatgatccaaaggccaaataagacctcgttggcaaagggaccgatcacgaggtaaagcggggcgtaaatgacgtctgttccgacaaagagcgcccccaatattagggcgatcaacatgatgaagataatgtctttgagtgtgaaatgcttcatggttttccctgacgaattgtcaaatcaagcgcaactttgtcccgaagaaaacttcaaatggactcttccagcctaagaccttacgtggtcggtgatttaaatccctgacaaacttgtcgatatcttgatcagttagttggtctaggtcggttcctttggggaaatactcacggataagcccgttggtattctcattggttccccgttgttggggcgcatggggatcgggaaaatagactggaatgcttagttcttggctaacttcacggtatcctgcgaattcagttccacggtccggcgtaagcgtccgaacgcgtttaggcgttacggtatgcaggaggtcaatcatcgcttgtgtgacgttcttggcgtttactttgagaacgcgctgagataataaataccgagatttacggtccactaaggttaccagggctgaacgcccggttttaccgcgaattgtatcaccttcccaatgaccaaaccggcttcgattctcacatgaaaccgggcgttcatgaacggaagggacgtcgttaaatcgtcctcgacgttccttaatggttcccttggcctttcgggttttaccacggtgacggagcttacgggcaaagccacgagccccgtgactcttacgtttgatgcctaaattatcgcgttcaatcccacgataaatggtgttataactgatacgccattcgctgttttcgtgggctaaacgacctgaaatctgttccggggaccactgacgttgaacaatacagtgaaggataaaatcccgtaacttcaagttagttagaagcctaggacgtcggctttttagtcgacgtccctgatagttctcttgggccttgacggctgagtaagccttacgaccgccattgcgtttgatctcgcgcgatacggtggctttagaacacccaatcctctgcgcaataacttgataggtgtccttcaaagtgacgcctaatagtatgcattctcggtcttttaaggtaagatggttgtacgaactcatagcctaagatctcctttagatgtttgttgtggtaacttcattttacaggactcaggctatgagttcttttttattttcttcttacttgttgcacttcaattgtaaattcgtcctccaaaaaaagcccttctgtccgggggcagaagagctggaatggcggggaaattccgttgattcaaccgtcttcctccgctagtattaactagatcaggttcaatgggtatttctcagctaaatcaatagcaccccagacagattctgatatttacgttaccctaagtcaactacacttccgcccaaaagaaaaggggcagtttgaattaccggggaccaaaatttacaagaactttaccaaagactgaccatagctcctcttccccttgctataatggtagctgaataaatttgcggcgcccctttaaagtagtcggggcgcaaggaggatatgctgtgcttgaaatactgaaagccctgatcttaggaatcgttgaagggatcaccgaatttttaccgatcagttcgaccggtcacctggtccttgtcgatgagtttattaagctcaacgaacccaagaagtttatcgacatgttcaacgtcgtgatccaacttggggccatcatggcggtggtggtcttgtacttccacaaactcaacccctggtcaccgaaaaagtcccgcttggaacggtcccaaacctggaccctgtggaaaaaggtgatcatcgccgtgattccttcggtgatcatcggcttaccgctcaacgactggatggacgcccacctcatgaactggctggtggtttcgatcgccctgatcgtttacggggtcttgttcatcgtaatcgaaaaccacaaccaaaacctacggccccgctttgacagcctcaacaccctaccttacaaggtggccattctgatcgggtgcttccagatcctctccttgatccccggaacgtcacggtcgggagctacgatcctaggggcgatcctcattgggacttcacgctacgtggccgccgaattctccttcttcttagcgatcccgaccatgttcggggcctccctgttgaagttgtacaagttcttcgcccacggcgggaccctggccggcaaccaaggcctcatcttggccgttggggtgatcgtttccttcgtggtggcctacgcctcgatccgtttcttgttaaattacatcaagaccaaggacttcaaggcctttgggtggtaccggatcatcctcggggtgatcgtgattgcctacttcgccctgttagcccactaatccgttaactgcatcaaaaagaccggctgtgattaccagccggtcttttttgatgcgacgaatttacaattgaagtgcaacaagtaagaagaaaataaaaaagaactcatagcctgagtcctgtaaaatgaagttaccacaacaaacatctaaaggagatcttaggctatgagttcgtacaaccatcttaccttaaaagaccgagaatgcatactattaggcgtcactttgaaggacacctatcaagttattgcgcagaggattgggtgttctaaagccaccgtatcgcgcgagatcaaacgcaatggcggtcgtaaggcttactcagccgtcaaggcccaagagaactatcagggacgtcgactaaaaagccgacgtcctaggcttctaactaacttgaagttacgggattttatccttcactgtattgttcaacgtcagtggtccccggaacagatttcaggtcgtttagcccacgaaaacagcgaatggcgtatcagttataacaccatttatcgtgggattgaacgcgataatttaggcatcaaacgtaagagtcacggggctcgtggctttgcccgtaagctccgtcaccgtggtaaaacccgaaaggccaagggaaccattaaggaacgtcgaggacgatttaacgacgtcccttccgttcatgaacgcccggtttcatgtgagaatcgaagccggtttggtcattgggaaggtgatacaattcgcggtaaaaccgggcgttcagccctggtaaccttagtggaccgtaaatctcggtatttattatctcagcgcgttctcaaagtaaacgccaagaacgtcacacaagcgatgattgacctcctgcataccgtaacgcctaaacgcgttcggacgcttacgccggaccgtggaactgaattcgcaggataccgtgaagttagccaagaactaagcattccagtctattttcccgatccccatgcgccccaacaacggggaaccaatgagaataccaacgggcttatccgtgagtatttccccaaaggaaccgacctagaccaactaactgatcaagatatcgacaagtttgtcagggatttaaatcaccgaccacgtaaggtcttaggctggaagagtccatttgaagttttcttcgggacaaagttgcgcttgatttgacaattcgtcgcagttagttaaccgtccaacccccatcggccttgacgatgtcgccgttgataaaacttgcttcgtctgaggccaagaagagggccaagttggcaatttgtcccggttgaccaattggggtctcaccagtggcctgcagggcttgcatccccagtgggtccggtgctgtaatcgtggtttggatgttggtagccaccccacctggcgcaatggcgttggcccgcaccttaccaaagcgtccgtacgtcccggcgatgtttttagtcaaccccaccaaagcgtgtttagccatggtgtaagccgccccaccccgggtcccgaagaggccaccgactgaggcgttattaatgatgaccccgccggtttcttgttttccatcacctgaatggccgcccgacatagcttaacagggccagtcaagttaatggccattacccgctcatattctgcgtcggttaggttcccgactggggtgaaattatccatgatccccgcgttgttgaccaagatgtccaattggccaaaggtctgggtggcaaagtcaatcaccccgtcaacgtcttcttgcttcacaacgttggtcaccttagcagcggcttagccacccgcctgttcaatcgcttgcttaacttcttcgatcccttgggcgttaatgtctgctaagaccaccttggccccttccttagcgaagagttggctgatcgccttccccattccggaaccagccccggttacaatagcgaccttacccgttaaacgtcccgtcataatggcaccatcctttcgttttcaattactgtaagcgttactactatcataatcatgacgttttgggttaaccactaatttcaacacaaaaagacgccgctgaggataacctcaacggcgccttttgggaataacgatcgggaatacaggattcgaacctgcgacctcttcgtcccgaacgaagcgctctaccaagctgagctaattcccgaggtatgcacccagaaggagtcgaaccttcaaccttctgattcgtagtcagacactctatccaattgcgctatgggtgcgtaagaaaaagcggaagacgggattcgaacccgcgacccccaccatggcaaggtgatgttctaccactgaactacttccgcaattttcggggtgattggcaattacttgcctttcaacgcttatatatgttactcttctagaccaactttgtcaattaattttttaaaataattaagttggttggtcaatgcggataagaggactcgaacctccacgtcataaagacacaagaacctaaatcttgcgcgtctgccagttccgccatatccgcatgacaaacgtcgaaaataaaaggacgatcccctcggacgccctaataaaatggaggatacagggctcgaacctgtgaccctctgcttgtaaggcagacgctctcccaactgagctaatcctccatgttaactgacaacttctatagtataggcgatgtcagtcaaactgtcaatcattactttaaatttaatgcagaaagttttgaatcgatttgttccaagacgaccttggccgcctgcggatccgccacaaagtcgtactggtcgccatcgatcatcatcttcgggctcttatcgtatgcctcgtaccaggattggtaacgctggttgagcgtcttgtagtactggtagaggctcgggtcgttttcgatttgttcaaaggaccgcccgcgttgcttgatccggttgagcatcgtttcaaaggagacccggatgtggatcaaaaggttgggcgccttttggtgggcctgatctggtaactcttccatcatgttccccaacaaggaggtgtagatatcagcttccgtgtgggtagcccgtcccaagtcagcgttcatcttaaacatcagggcgtcttcaaagattgaccggtccaacacgttcaaatcgttatcaaaggaatccttgatttcgtctaggcgcctgtttaaaaagtaaatctgcaacaagaacccgtacttttgcgggtctttgtaaaagaggggcaagatcgggttgtcatcgaccgattcaaaaaacggcttacttcccaggtggtcggcgagcatctgcgtcaggctcgtcttccccgccccaatcgttccggctaatacaatcatccgttaaacctcacttattcgttccgtttcaaaagacacaaggactattctaacacccccgcggtcatttttgaaaagaaaaaaccaagggtggttgaaaatacaacgccccttggttttcggtcttaacttacttatcttcggttggctcgtagctttcccccttggtcgaccgggaaagatcggcgtcagtcggcttaatcatcttagagccgtaacgaagcttgtagtacaggtacaaaacaatgtagatcggcaccgccatgtaagtgatggcaatgttggaccaatccaacttggcaaaggcactcaggttctgggccacgattacgacgatacataatacgaaggcgaaaataggaccaaacgggaaccacttagcgtgatacttgagttcggacagttggtgtccctgggccaagaaggccttccggaagcagtagtgtgaaatagcgatccccaaccaggcgataaacccacagagcccggaagcactgattaagtagttgtaggcgttagggccaatgaattgggttgcccacaccaggatgccgaccaccgttgtccctaacagaccgtaaatcggaatcccacgcttgttaacgtaaccaaacatcttccaagcgtaaccttcccgggcctgggagtacaacatccgcgttgatgcgtacatccaggagttggccgaagaaaggacggccaccaggatgacggcgttcataaccgacgcagcggcggctaaaccggcccgcttaaagatcagggtaaacggtgaggtcacgatgtcttgcacgtcagacgacagcaggtgcggatcggtgtacggtaagatgcaagcaatcacgaagatcgtcaaaatgtagaacaagaggatccgccagaaggtggacttgatcgcttctggaaccgccttttccgggttttccgattccccggcggtgatcccgatcatttcggtcccctgaaaggagaatccagccaccaagaagacggtgatgatgccgggtaccccgttaacaaacggcgccttcttgtaggtaaagttagtcaaatcggttggtccttggccacccatgatcccgaggatcactaagacccccacgatgataaagatgataacggtgaccaccttgatcaaggctaaccagaattccgtttccccgtaagaacgaaccgacaggtaattaatgatgaagatcaagataaaggcgaccccggaaaagacccaggccggtacgtggggaagccagaagttcatcactaacccgaccgtggtgatttccaccggcactgtgatagcggcgttaaaccagtagttccacccgagggcaaacccggttgccggcgagacgaacttacttgcgtaggcggcaaaggacccggtcagcgggatgtaagtcgccatttcagccaaactggtcatcaagaagtagaccattacccccatgaccgcgtaggcaatcagggcgccccctggtccggccgtggtaattgccgacccggatgcgatgaaaagcccggtcccaattgatcccccgagcgcgatcattgttaagtggcgcgtctttagcgtccgttcaatgtggccgccttgtgtgccagatgattgttgctcatccatgattttcctcctatatggctaaagaggtggggcaaaattaaggggccccctagcaagtgctagaagacccaactcatgatttgaattagtatctggaagcactccgcaaactgcgacagtccgtggcctcttaagccacgtcccaacaaaggtaacagcaaaattaccgatgtttcggcacgacaccctttcaaacgggctggggcatttgcttgcctaacccgccatactgatgagtcgtgcgacctcttcttgtgtgataaacataagtattttataacggggattgggggatggcaaccccttttctaagaaagttctaagcaccagttaacgaccgcctcattttcagccgtccttataaatccatttctagccaagaccgttgccgaagcgtaattatcgccccgagtttgcgcctcaacccgtttcgtttgccccccggcccgtaagttagaaattaatatttgcagcgccctagtcatcagcccttggccctgccagggtctcaagatcaagtagcccacttcacgaacccctttttcaatcatgaaactagtcgctaagccaacccgactatcacctagggtaattacccagaagtcacccgactggcgccacatggcaaaggcccattggcgggcacttggattatcacttagggtaagacccacctctttgactagctgggggtcggaaaaacattggttaacaaagcccatgtccgcttcggtcaccaagcggatgtctaactgtttttgtggatctgcttgcactataattaccccatagatttatgattacagaaaggaagtttgttatggaaattaaaacactttcactgaccaacggcaagcaaacaacccaagcgagcctgaccgcttacctgcagacccccacccccaaggcccccgttcaagcattcccggccctgatctttgtcccgggcgggtcaatgacccacatcccagaagaagaatcggaaaaaacggccctgacctttgctgccttaggctaccaggtcttcatcctgcgctacagctttgtcggcgaggccacgcccctctaccccgccccgctccttgatttggcccaggctgtgagcttggttcaccatcacgaagattcttggcacctgaacggcaaggttgccgtaatgggtttttccgccgggggtcaagtagtggcactctacaacgactactggcaatcaacctggttaggggaagagagtggtttaacagaggccgagcgtcacttcgacgccgccgtcctcggctacccggttattgacctcgacctgggctttccagacgaagccacccttaccaagtggaccgacgacccggccaaatataacgctagtcaccacgtcaaccaagcaaaccgccccactttcacttgggctacggttaccgaccccttgattacggtgcaaaactcccttaattacgtccaagccctgcaacgggaaaacatttcccaggaaatccacctctttgacggcggtccccacgccatggacgtggcaaccgatctggttggacccacggtagaacctcacaaaacccacgttcaccactgggtcacccttgccgatgagtggctcacccaaacactctccctataacggcggaaaattaaacaaggggtgggtgagaaataacatccgctgtgggtcgtacgtaaaatcggccgaacgtttgatacggcacacaccattctgcggcctgcttagtcactaggcctgtggttattccccgcattttctatctaacattcgtgaatacagtaagaggctgtgagaaatgcgcttttctcacagcctcttgttgttttttcgcatgtttaataccaagagttatgggtcatcttccagcgccgcagccgtggggcgtaccgaacgtacaccccttcggaaaattgtagccaggcgtaagccaacagcatggcgccaaaggtgtcagatgggtagtgggcctgcaagtatacccgtgagattgccacgaggaccaccgcaaagatcaacaccagttgaataattacccgggtggccccactccgaatcaacggtaccacgaccaggctaatgatcgccgcaatcaagaagaagcccaaaacgtgaccactcgggaaggagtagccggtgtcagacaccgggtgttgggccgggcggtcccgcttaataacgtgtttgacgatggtccctaaaacgtcacccccaaagagggtcaagagggcccaaaccgcgggaattttccccttaaagccccagaggaaaaaggcaataattaagccccagaggatatccattttcgggctagccaaaaaggcggtccacaccattagggtgtggacaaaaccggtcgtcttgctagaggtaaagagggcctggcagaccgtgtctaccgttgtgatcagcatcgaattcttataaatcatcgcagccaccaccaaaaaaatgacggttgtcacgatcaagcgcatgggacgcttgcgatctcgttcaattagcattttaataaatctccatttgcaaagtatgtgctgagtataccacgttgtcgaatctcaatcacgttttttccagcccttgagttggctaaagggccgggcctctttgcggtggcgaccgtacaaagcggtgttgattaggtcaccgagcccaaagcccagggtaatcgccccggcaatcacgaccacctgataaaggtaggataaggacagcccgtaatcgcccaaaacaaagtaacgcaccaccttgtacgcctggccaccgggcacaaaggggaccagggccggaacgttatacaaaatcattggctggtgctgaaccttggccgccatcatcgcgagaatcccgattaaaatcgcggcgctcaagtttgaaagggctaagccaacgtgcaggtgaaagtacattaccacgtaaatcacccaggtcgcccccccgattacgcccccagctaagtaagcgcgccgggggacgttaagtaaaatggcaaagcaaatcgtagccacaaaggcaaaaacaaagtggagcaagagtcgttcaatcatggccaccccctataagtaccgcaagacaaggacaattgcacacccaatggaagccgccgtcagaacggcttccagcgcccgggcgatcccagaaattacgttaccagacacaatatcgcgcgccgcattggtaattggcaccccgggtaccagagacatgatggcaccaatgatgatgtcgtccacccggtgggcaaagccaaggtggaccgccgtgctggctagggccccaatcactaaggccgtgcaaaattcccccaggtaacgaaccttgaaggtactaaccaaccacaggtagacccagtaggaaaagccgccgaccaaaaaggccaccagcgtatccttggtatcgcccgtaaagacaaccatcaagacacaactcatcaccgctgctgctaagcactgtaacaaggccggctgcttagtggaaatttgatcgacgaggcttaggcgctggtaggccgcccgcaagtcaatcttacggtcggcaaaatcccgcgaaatggcgttgacctgggcaatcctagttaagtcggtgcggcggatccggacgtcaactacctgggcgttggagcggtgattcgatgaggcaacgaccccggtcaccgtagtaaaggcttgaaacgactgcagaccggcgttggccgcgattcggtacatcgtgtcattaacccgctccatgtttgacccgttttcaattaggatctgccccgccagtaggcaggtactgattgccaggtcggtttcttcttgtgtcatggctagccacccccttattcgatagcaacattatgcaagggcgccgtcatgattgacaagccttttcggacaaaaacttatcatcaatcaagccaacgagagattccccggctttcaaagcaaacaaaaaacgggcggcgacataagtcaccacccgctttttaaaaatgattacgccttagaaacgttggctgcttggagcccacggtcgccggtttcaacgtcgaacgttaccgattgaccttcttctaaagtcttgaagccgtcgccttggatggcggagaagtgaacgaacacgtcgtcaccagcttcgcgggaaataaacccgtaacccttttcgtcattaaaccacttaatagttcctttttccatggatgaatcctcctattaaaacaaatgtatcaaacttggtaattctacctgagcaaactggaagattccttcaatgaaacaatttaccacttcgtacccgagtcaaactacttttataagtatagcatgcgccccactataaagctacttatttatctttcggcgtaataaaaacgttgtgcgccgccttgtaagagatgttgagcgtttgaccatccgttagtcgctcaaccacgaccggcccctcaaagggttcgtgcttaacaatcttaatgtgatcgcgcaaccgtaagccaatctcactaaggtaggtcaaaaggtcgtgattatccaagaagcgctcaatgattacctcttcgccatcttccccctccgccagtaagcggtggctaatattggtgaagcggccgttggcactagggatcacgcccccatgcgggcagtaggccgggtgccccaagaaatcatccaaggcggttgccaagtggtcgctggtcttgtgctccaagatctcggcctcggggtggacgtcagtcatgttatagtgaagcttatcaactaagaaggtttcccacaggcggtgcttacgaaccaattccgctgcgtagcgtccccctttttcggttagagcgatgccagcgtaaggttcatgctctacgagtccttcatcggccaacttggtgatcatttcggtcacggacccggcggcgattcctagccccagggaaatttccttgttggaaacctttttgcggccccctcctagctcaaagataatcttcaaataatcttctttcattggcgtcattgtatcgcctcaaaccttctttctttttgttcggatcactttgtcccggttgaatccagaatgattatagcatatcattaatttaacgatttggataacctaaacttttgtttttaaagaattaatttttcctgtaccaaggggggagaccaatgcataacaaccgggtgagtggcggccgttttctagccgtcaccatcttaaacgtcgccatcaccattgttgaaatcatcggggggctcttatccgggagcctcgccctactttccgacgcctttcataaccttggtgactcactttcaattgtgctgggctactttgcccaatcaattgccggacgaccggaaaaccaccggcgcacctatggttaccggcgggcggaaattctagccgccatgctaaacgccctctttttaatcgtggtgtccgtctttttaatcattgaggccattaaacacctccaccatcccgaacacgttaacggaccaatcatgctcaccgttgccattgtcggtttactggccaacctgatctcggccggcctcttacaaggagggagtcaccacagcctaaacgtcagagctacctacttacacgtcttatctgatgccctatcttcggtcgccgtgatcctcggcgggctagttctaaccttcgtcaacctcccctggttggacccggttttaacgatcgccgttgccctttacattggctatgaagccatccccatcattcaccagactttgagcattctaatgcaatcggccccccgcctcgactacgaccaaatcaaacaggacctgctcggaattgacggggtcgtcaacgtccaccacgtccacgcctggtcgatcgatgaacaccggatcatcttttctgcccacttgaattgccaagacatgctcttgagccaggttgaagaagtctaccaccaggccgaacaaatcctcgaaaccaagtacggcatttgccacgtcaccattcaagccgagtgcttacggggccaagacgaggagctcttcgacaccccaccggaccgtcaaagcatttgcgaataatatgcgcttcgtataacatttaaaattataaaagtgaggcagggaggaaaacggatttctctctgcctcttactgtatatcagaatgttagagagaaagcgtggccaacaactatgtgcctagtcatccgacctgcagctaattgccactctctttaaaataaccgtccaacgccgtagtgaatggtgatcgtgattaaaccaatcacgatgtttctaattacggcgaccttaaccaacccattccccaacttcgaggaaatgtaaccggtcaaagcagacgataagatcactgctaagattgtcgcgtaccacttcaagcccgccggggccaaaatcatcgccattagaggtaagatcccccctagagcagccgcaaatagcgaggcaaaggcggcgtcccacgggttgaggtagtggccaagttcaatatcatatttaactcgcacaattgttttcaagggcgccttggccatcaaatcctcagcgattgactgggccgttttttcactgagccccttttcttggtagtaggcccgcacggcgctcacttccccgtcccagtccgttttcaacaagccttcttctttggcaacggcggtccgttcggtatccttttgggtggagacggaggcgtactcaccggaggccattgaaaaggcacaggccaaaaggtccgataatcccgcaattaagatcgtgaattgatcggtggtggccgcagccacggataccaagaccccgactacggtcaaaattccgtcgttagagcctaagacaccggcccgcaaggtattcaggcgctcttccatcgtttgcttatggaggtttttaaccttaactttttgcattttaatccccctttagcttaacgggcaaagagctgcccaatgacgaaggttaccgccatcgttaacaggccggccactacgttacgaaccaccgactttccgcgttcagcgtcccccaacaccgctgccgcgtacccggtgatgcatagggcgatcaaaacggcgaccacggtggcccaaatccgggtggccgccggagtaatcatcaccgccaccattggcaggatcgaaccaagcggaaacgagatcatagaagcgatcgccgccgcataagggctggtgaattcatgggggttaaagccatggcgttccaggacaaccgtccctaacgcatctttagccatcaactcgttggtcgcttgggtggctagcgcgggggcaatcccctgatccaggtactttttcttcacgaagtcatactcgctttggtagtcttcgtctaggcgttccttttcttcaatcagggccattcgttgcgagtccttttgggtagaaaccgaaacgtattcccccattgccattgagatcgtcccggccagggcccccgataaaccggcaattaaaattgcataaccattgctagtggccgctgccaccccaatgacgatccccgccaccgaaataatgccatcgttggcgcccatcacgctagcccgcaaaatgttaatccgccgcgctaacgatgtttttttcttcgccattacgccaccccttcgtcttttactttagaaccattataatataactgaatataaaagcaaatggtttatcaaatttatagcttaaaattttagaagaattctaaaaaaacggacacaccttaatcggcgttgtccgtctcgggcgggatgctattgataatcccggatctcttccgtgcgaatcacaaagactgaggttccggcgtgcttagtcatgtaagaggcttgggagcccaccaccttgcgatttcccggcttactaatcgagcctacaatcagcaagtccggttggaactctggaatgacgtggttacaaatccgttcagcgggacggtccccctcgtctacgatcgccgtgatctttttggggtcaatcccgtaatcaatggcggcctgaacgtattcatcgatccgtttttcgaggtcctggcggctggtgtgaacgtaatccttgtcgagggcttggaagacgttaaccgtgttggtttcgtgaatggatacaatccctaattcactaccgtcacgcttggccttccccacggcgtaggcaaaagctgcccgggcatcgggtgcgtcatcgaccccgacgagaatcttatggaacgtttttggcttaatttcaaacatgaaatttctcctctctttcgggggccggcaacccggatcgtccccctaattgtgttcataaattagtattgcactattagcaccgattgtaaatcagattttttagccttccctaattttattttctaaccctagaaattcatcccattgtcgcagccctgatccgtgctatacttagtcaatcatctttttaggggggccttcgatgctgttggataagacattttcgcaattaaccaccactgaactctttcaaatttaccggctccgggcggccgtcttcatcgtggcccagtcccgggtcgtccaagaccccgacgacgtcgacctcatcgctcgccatattttcatcaaggacggagacgcaatcgtcgcatacgctcgggtgtaccctgcggacggcggcgtttcctttgggcgggtcgtcaccgcggccagccatcgcggccaaggactgggccgggaattaatggatggcgtaatggactgcatccggaaatatttcccgggaaatcccatccatatccacgcccaagaacaggtagaacgtttctactaccagtggggcttccaaagcgaaggggcgccgtttattctcgcccaaaccccacacgttaaaatgacccaccccgccatataaacaaacctccaccccgaccatcaacttagtcagggtggaggtttttaattagaagcgaaaatcaaggcggtagccaaagctttggtcactccccatcaagcgttgggcgtgccgttctagcaccgtccgccgcttaccgtgcatcatccacaccgttagaaggatgaagaagaacagttccactaacgtcaacacccagctagaggtggttggcgttccggttaagagggtaacccccccagttccatcagccgcaaaggctaaccaatcaaataaaaagtgcatcaaaatcgttaaccaaagctggccggtgtacaaaaagaccaccaggtaaaaaaggccaaatcccacggtccccgtgatctgcaggacggtatctgctaagggttgaccagccgcgttcaagaggtgggcgaacccaaacagtagcgccgaaacggccaaggggccaccaaggggccagcgggtgttttttaaggccaccaaaaggaccgccaagataacaaagcggtaaagggtttcttccccaattccggcacacagggccaccaaaaagttactgctactagttaggccctggcgcagggtcgttaggctaaccccacctatgttaactccggtcacgaccaggtccacggccaccaggaaggcgaaggtcagccagctccagccccaaccaaatttaggcaggaggccaggccaagccagctcccaggcccgcatgagggtagtagcggtgattaaaaaggccaacgcccccaccacgtgagagctaacgatggtttgcatgatcggcggcccagcgaacttcaccggtagggaaattgtcattcctaaaataatcaacaagaaccagtaaaagctgtagcaaagccgggaaagcccccacttaaaggcacccccaatttcgctagcaaggggggcgaacatgatcagatagtagattagggccaaaacgacgacgccccgggccggaagctggagccgaacgataatttggcgggtcaccgttccccagaccatgagcaaggccaggggctgaaagatggcttgtagccaacggttggtggccgctagccatgtagggaccgccggcagggaggcaacgattagcccaattgccgtaattacgcctaaaaaaatcatcaggtagccctgatggatgccaacgtacatttcccacccactaataacgagcaggaaaaagagtgcggcgaccaattgggtctcataccagatgtgcaggtaatctcttcctgacatcttattacctccaatcaaactttcatttcctataactatgatggtaacaaagtcccgggtcaagcaaaagggaaaagcaaaattttaatgttcgtacaatcaaaaagggccctgccaagttcgttaaccgaacctaccggaaccctaattgcctacgaaacctgatttaactattcggtgaccgtagccgtttccttcgcagccgttttcttggcgttcggacgacacttacggttgttacgccgggttgccccggatccttccttaccatcttcggcttggtttttctttggtgcccgttcctgagcatcggcgtttaggatcgtcaccatcggaataatgactgggcgccggccggtccggtcgtacaagagccgttgcaaacgtaagacgatcatccggttaatggcccggcgatcaacccgcttgtggttcttgaaggtgtttaggatcgcccagaagacttcgtgattggccgccttgatcagttcctgggattcgtgcatgtaaacaaagccccgggaaacaatatctggccccgccacgatctggtagtcctttaagtcgaccacggccactgccgttacaaccccttcttcggagagcatccgccgttcgcgaatttccggatcaccaactgaatcgctgacgtcgcgtccatcaatgtaaacgtcccccatcgattcgatgtggtcggctaagcgacaggtgtccttggtcaaggccagaacgtccccgttttccaggatgaaggtgttttcctttggcaccccggtcaattgggccagcttagtgtggatcttttgcatccggtattcaccgtggaccggggcgaagaacttcggcttcatcaagcgcagcattagttcttcgtcaatttggcccccgtgcccggacgtgtggatgttgttaacgtaaccatggataacggtagcgccgctttcttccaacttgttaatcagggcgttgaccgaagtcgtgttccccggaattgggttggaggagaagaccaccgtatcttcaggttggatcgtgatctgacggtgggtcccgttagcgatccgtgatagggcggccatcggttccccctgcgaaccagtacacatgatcatgaccttttccggtgggtaggagtttaactcgttggggtcgatcaaggagtcttccgggatctttaggtaacccagtgcctgacccgccgcaatggcgttttccattgaccgaccaaaaatggcgatcttgcggccctggcgcatggcggcgtcagaggcttcccgcaaccggtaaacgttggaggcaaaggaggcaaagatgatccgccccttaattcgttcgaagacccgccgaatatggatgtcaacccagcgttcggacttagtgaactccggccgttcggcgttggtggagtccgaggtcaacaagagcaccccttcttcacccagcttggccatttgttggaagttgggcgccggcaagttgccaaccggggttaaatcaaacttgaagtccccggtttgaatgatcgtcccttgcggggtgtgaaccgctacccccaccgtatccggaatcgagtgggtagtccggaagaaggaaacccacagcttcttaaagtgaacctcggagaattcatcaatctcgtgcagttccgtactccgcaagaggtgcttttcgtctaacttccccttaatcaacgaggtggcaaacggaccggcatagatcggcacgttaaccttttgcaagaagaagggcaagcctccaatgtggtcttcgtgaccgtgggtaatgaaaattcctttaatcttttccttattttcaactaggtaatcgtaattttgaatgacgtaattgaccccgagtagttcgtcttccgggaagagtaccccacagtcaatgatcacaatttcatcttggaactgaacacagtacatgttcttcccaatctcccccaggcccccgacagcaaagaaggccacttcattattcttaatttgtaacttacgcataagtacctttcctttatctttagttgcgataacgatcggaacttctggatacaccaaaaggagggcttctccagttgttgccgccctgacgtttaattcagtttttcgttattttttcgtccgtaataaactatgaatagtttaccacatgcggggggtgaatcatagttggatcacctgagtaactaaaacggggccaagagaaagcgaatttccctcaaccccgtttaaatctttaaagatagttcggttttagtcccctaagcacaaattagttttctttaattaggccggcgtgcttatcggcgtaccactgttgccaagtagtagtggtatgcccccgttgatcataggtcatgtcgagggccgctaagaccccccggtaagccgctaccgtcatccggaggctaacggcggtgtcgtgttcaatcgtcccctgccggttctcacctaaaacgtgattaatttcagccaccaagcggtcatcggccagggccgcaatgatctccaaatcatcgtgcttaaagtgtgctacgtaaaaaggagcaaattccattaccgccacggtctgtgcttcgtcatttaactgattaaattggtattgttctggcattttttgccttcctttcacaaccaagacaacctgtttctactatataaatatagcctagcactttttagcgggttcggcatagaagagtcaccaattatttagtatcaaacaggcgtaactccacatggtcatcttctttgacgatcgcctccaccgacttcttggggttgtctgctaagggccctaaatcaatgcgggttccctcattagtcgcctctatttcaaaggcccggtcaacaataaagcgctgaaagtccttcatttgactgcgccgttcgtcttcttttgcaaccgccactggtagggtgtaaccctcatctaagtagtacttaatccccattacctgaaagagggttgctaactggtatttatggctggaattttcttgggtttgctccgagtggatgtagcccttgcgctcccaatagcggagctgactgggtgagacttccgcggcttcggctagttctcgcatacttagccgcaggttcgccttgataaatcgtttccggtagatcgatgctagcgacacgcctatccctcctcttaatttacgaaataaaacagggttattatctaattttgcgtaatctttgtcaaataatttgacaaagatctccaagagtaatatattaattcctgtttaaattttacaaaaagtaagaaagaaggctttatcttgcagtccaatcaacgaccaatggacatcaacggcaagccatacaaccgggcgattctggttgccgtgctgaccgttggttccttctttacgatgttgaccgggaccttcttggcgaccgcttaccccgccatcatgcgttcctttgacatttccacttcgaccgttcagtggttgacgactagtttcatgctggtgaccgggatcatgatcccgatctcggcttggttaatcaacaagctgaactcccgggtgatgtacatttcggcgatggcgacgttcttaatcggaacgatcatcgcctttaccgccccgaacttcggcctcctcttaactggccgggtgatccaatcaatcggggtaggggtttcgatgccgctaaaccagaccgtcatgttatcgatcttcccgccggaaaagcggggcgccgccatgggggtggtgggggtcgccatggggttagcccctgccgttggtccaaccatgtccggtttgatcgtcgacaattggtcctggcgggacctcttcgggatcatgattccagccatcgtgatcgtgattgccctagccctggtttacatgaagccagtgctaaaggtgcaccaacaaccaatggatctttggtcaatcatcacttctacggttgggttcgggggcctcttgtacggggtttcagaagcatccaaccgtggctggggtgacgccttagtcctgtcttgcatcgtgatcgggatcatctttatcgtcctttttgcccaccggcaactccacttggacgaccccttcttggacctaaccatcttcaagtacggtgaatttaccctggcggccgttttatccagtgccgttaacttggccatggtcggggtggaaatgctgttgccgttatacatccaaaatatccgtggtgaatcggccttccactccgggttaatgctgttgccgggggctttgatgctggggttaatgtctccagtaactgggcgcttattcgaccgttacggggcccggttcctttcgatcaccgggttgaccctcttgatcatcggaacggtgccgtttttaaccctgactaaaaacacccccgttatttcaatcgtggtcttctacgccattcggttatttggggtctcaatggtctttatgccggtaacgacctcggggatgaacgtcttgccaatcacggaaatggcgcacgggacggctgttaacaacaccttccgccagacgatgagttccattgggaccgccattatgacgaccgtcttgaccaacgtcaccaacatgcaaaaaccaacccacgccctactagaaaaggcacccctttcctacaaggaccactacatcaacgctactctggccggtttccacgccgccttcttggtggccgccctctttgccgtgatctccttgatcctcgccttcttcctgaagaacggtaaccgggcccgcgaaatcgccttgcaacaacagaagggggaataagcaatgatcatcgtcttagtattactatcaacaattgccttttacctcttcaccgccgtttggcaaaaaatgcccggccgaacgctctggtcgttagtaagtctagtcgtcttggtgctttcgatcgtgtcctttgttttacacgataaccgccacatgggaatgaaactagaaacgaccaacaccacttctagcttggtgtctcccaacaagaacctcaacgtcttagtgtacaagcagctaggatctgggagtgaaaaggtctacgtctacaagaccgaccccaacgccaagaaaaccactacaacgcgcctagccgccaacactaagtcaacggtgaagaccaccacgtcaaccaacgccacggtggttaagcacaccaagcgttgggtttacaagaatggtttttccaagctgatgtttggcatcttaggcgacgataacgaagtcgaccaagtaacctacaccttcaacatcaacgaccagtggctggttctttctagcacccaagccgctaagttacaagccctgatgaaggacgtcaccgctcaagcagcgatgaagtccaaggtcgctgccctagtccaggaggaagtggccgccagactcaaggctaacccaacgatgagcgccactgaccaagccgcgctccaggctgccgctttaaagagcgctgaggcaaccgttatcggccaaatgttaaagtaattaatgccacactaaaagggactctccgaattggggagccccttttttgtggttagaggaattgttagctaaagagtgtggggtaaataactacttgatgttgataaagtcgaccttgaacaaacgtgccaattgttctaattgttcttcacttagggctagggtcaagacggtgtggtgaccaccaccgtacttcatccattgcttagcaccctcagccaacccaatttctggcgtccacatttgcttagcgaccggcaacttcggcatttcggcttctggcgtcttgcagtcaaccgggtagccaatgaacttgtagccatcatcgaagtaagacagggtaatgtcgtaacccttcccttcggccccagtgaagaccaggcgcgccgggtcgtccttgccaccaatccccagtgggtgaacttccacgcgcggcttgtcggaggccagggttgggtcaacttctagcatgtgcgaacccatgatggcttcgtgaccgtgacgaaggtccagcgtgtagtcttccatcagggcggtttgcttgttgtcggcggcaatcttaagcaatcgggttaagccggccatcttgaagtccccttcaggaccaaagccgtaaccatcaatcatcaacagttgaacggccagccctggcagttgttctaagccttccaggtcttggaagttgtcggtgaaggcatcgtagccattgtcatccaagaacttcttgatccccaggtattcacggagttggtagcgaacgttgtgaacgtacttttcgtggtcgttgtcaccttcaaccaagtcatagttagcttccaagtccttgtaagcggcgtcgatttcgtcttcggcgatttcgtttaccaccgctaccaattcgttggtcgggtagtaatcaactgtccaaccaagcttgatttgagcggccaccttgtcaccttccgtaacggccacgtcacgcatcgtgtccccaaagcgggcgatcttaatgtggaaggattcgttgtaagcaaccgcaacgtgttgccagtccgcaatttgttcttgaacgtctgcatcgccccaccagccgtaaacgctagctgccggaacattgagccgggagttaatataggcgtactcgcggtccccgtgggcactttggtgcaagttcatgtagtccatatcgatggagtcaaacggaatgttgtttaagaattgggttgccaagtgcaggagcggcttttgcaggagttccgtcccccggatccagttcttggccggtgagaaggtgtgcatccaagtaattaccccagctacatcatcattgtagttggcttccttcatgaacttcgtgatgctgtcggccgtcgtagcaaccagcttaaattcaaccgggtagtcaagcttaccgccttcgtttaagccatcaacgagcttgcgagcgtccttttcaacctctgccagcgcttccgggccgtaaagcggttggctaccaacaacaaaccagaacttgtaatcttgcatcttacgcatgtttagatcccctttgttttgatcaacgacgagttcgtcgcttgttactaaatgtggattaatcgcttacattttggattgtattatatttgtccgtacaattcaaggtgtaatataaatttattatctttttatcggttgaggccttgttcctcaatttgttccagggtcttcccttgggtttctggaacccgagtcttaacaaagataacccccagcacacagatcaccccaaagatggcgaagacggcttcttgcgacatcgccccggtcatcaccgggaagatcagaccaactaaccaagaaccaacccagttcatggatgaagcaatcccagaggcccgcccccgaatggaaagcgggaagatttccccgacaatcacccaagttaaaggtgcccaagtgaaggagtaaaaggccacgtaaatgctcaagaagagaacgatcatcattgggctagcattcggtactaaccacttgatgattgatggcaagaagaaggacagcgccatgaccgttcccccggtcatgattaacgtccgtcgcttaatcttgtcggcaattgcgataaagagcagtgaccctaagacgaggattaccccctggataattggccacatcaaagctgaactagcggcactaccagtagccttttcaacgattagcgggatgtagtagaaaatggcgttggcaccctggaactgctggaaggtggccaccccaaccccagcaattaccaggtagcggtacttcttgctaaagagcgttgcaaagttgatattcttagccgcttggctttcttccttggcagtttccttgatttgactaatttcaccgtcaatctcttcttgtgaagaacggatcattgataagacattgcgggctgccttctcatcaccgttgtgcagtaagaaccgtggtgattctggtaggcgtgacactccaaagaagaggataacagctggaatggcagcgcagaataacattgaccgccatgaccaatcaccaggcaaatccttgagcaagtagtccatgatgtaagaaagaagcatcccggacacgatcatcgtttggtttaatccggataaacgtccccgcattttagctggtgccatttcagacatataggcaggtaccaaagctgaggcagccccaacggctaaccctaaaaagatccggacgacaatcaagaagatcgcccctttatacggagccatactcgagagaacagatcccaaggtaaagataattgctgagtaaagaataaccttccggcgtcccaaacggtcagataattgaccagccaatgcacccccaaagatggccccaaacataacggctgacgtaatccaaccaactaagcttgagctactagaaaggctccagtccgtttgcaaaaacggcaacgccccggtcataaccccaatgtcataaccgaagagaattcccccgaacgaaccgaagaaatagataaacttgttcgaaattttcttgtccatattggtttaacactccacttttcttgatttgactatcaaagcgattgtagcgtcttattactgtaagcgatttcacgaaaatattataaaacgcttaccatataaatacaatatatattttggagtaaaacgataaattatactgaacaatatcgactaaaagcaacaaaagagccggtccccataacgaggaccggcttgtgaaagtcaggataattattttattgggggcgtaattgattcggtgtataccatcttcaaatcatacaaaatcggcgcaacctcttctccattaattctggccataatcatctttcccgcatctaaccccatcttttcctttggatgctcaatcgtcgttaagcgcggttctaagtaacgggacaagacgaaatcatcaaagcccacaatactaacgtcctcaggaatcgtcaggtccaaggaacgaataacatccatgatttgaattgctaactcatcgttataacaaaccaccgccgttgggcgctccggtttatccaagattcgggcaacctgttccaagaccttggtcatatcttggccagactggtacatcaccgtttcactgaggtaagaaatttccgggtgggccatgtaggcgttaataaagccttgcatccggtgcaagccttgcatgtcatcaacctggaagatccccaaaatccgttggtgccccatccccatcaggtgctcaaccatttcccgttcggcttcgcgatccttaacctctaagtacggggcatcaagctgtgggtagtgagcgttaatgaagatgcagggaatttgttgcttggcaacttcttggtacaggtcaatgttgggatccggcagcgcgctttgggttggttcaatgattaagccagcgaccttgttgtcgatcatttgccggaggctttgacgctccttatcccggttattatgggtattgctgacaattaacgagtagccctgggccgagattgcccggtcaatcccactgatgatgctcgggaagatgtaatcagccagatgggtggtgacgaccccaatcatcttgttattaatggcttgttggcgttggttcccctgccagtcgtcaacgtacatcccgccaccttgaatccgataaacgtaatgttcgttttggaggtcactaattgcccggcgaaccgtgtagcggctaaccccgtattggtccattagctcggattcagttgggagtttatcaccgacgctatattccccactctcaatgaccgtttgcaggccgcgcttcacgatttcgtacttgttttctgccattggtttcccccttgacgccctttcccttagtaataatgcttcctattttacgaaatttggttttccatgtctaattttacgttaattatcaattaaaagtaacataaaaaacgggtacccctcctgagtggggcgcccgttaagatgttacccggtcattatgcgtgctgtgcgtgttccttggacttagcgttatcttggccgtagtaggcgttaacgccgtgcttgcggtagtagtgcttgtccaacaggtattgtggcagctgagtgttatccatcgtcatttgcatcgtgtggaagtcctcttcggccaccacttctaagaccttggcgttgtaaacggccttagctggcgttggcccccaggtgaacggaccgtgttgggataccagggttcctggcgttgcttcgtagtccaggccccgttcttcaaaggtcttgacgatcgtcttcccggtgttgccttcgtaatcttcttcaatttcttccttggtcagggcgtcggccgctggaatgtcagtaaagaaggtgtcggcgtgggtggtattcatggccgggatgtcgagcttagcagcggcaaaggaaactgcccacggggagtgggtgtgcacgatcccaccgatcttcgggaagtggttgtagaggtaggtgtgggttggcgtgtcagaagatgggttgtagtccccttcgacaacttcccccttcaggttcacgaccaccatgtcgctaggcttcaattcgtcatacggtaccccggacggcttgatgacgtagaggcccttttcgcggtcgattccggaaacgttcccccaggtaaaggtcaccaggtccagttctggcagttgcatgttggcttcgtaaacttcttgctttaattcttctaacatagcggtgctcctaatctaatttcatcgcctcaccagcggctaattcggctggcatggcttgcttgtagttatcaacaaacttctcgtagccacgaacactttccggttccggatacagggtggcactttcggtatccacaaagacttcttggtctaaataatcagccaaacccttattgcggtgatctaaagcgtacagggccaagacggccatcccccatgggccaccttcaccggcgttttccatcacagtgatcggggtgtccaaagcatcggccagggcttgttgagccaccaccggcgtcttaaagaggcccccttgggcaatcaaaacgtcggtcttaatgtgttcttcgcgtagcaaaatgtccatcccaatcttgagtggagcaaaggcggaatagagctgaaccttaaagaggttggcgagggtgaagtggctgtctggcttacgtactagcatcgggcgcccatcttggacccgggtgatgttttccccggagaggtaggcaaagttaactaagccacccccgtcttgttccccccgtaaggaggcgtcaaagagcttttcgtagagttcgtttggcttcagggtgacccctagggtgcgagcaaattggtcgaacaagctggcccaggcgttgatatcagatgaacaattgttagtgtggaccatggcgactggcgcaccgtctggcgtggtgaccatgtcaatgtcgcggtgaacctggttcatttcttggtccaagaccaccattgaaaaggccgacgtccccacggagatgttcccggtccgcttggcaaccgcgttagtagccaccatcccggttccagcatccccttctgacggtgctagtaaggagcccgcttgaagttgcccagatgggtctaacaattgcgccccttccttagtcaggtgaccggcgctctgtccggctagcaaaacctttggcaagacgtcttcaatcttccagtcaaaggcagccacttccggcagggcgctaaacttttgtagcatcgcttggttataatcatgggtggcttcatcaatcgggaacatcccggaggcgtccccaatcccggtcgtcttttcgccagtcagcttccaggtcacgtaaccatccaaggtcgtcataaagtccagatccttgacgtggtcttcttgattgaggatggcctggtagaggtgggcaatactccaacgttccgggatgttgaagtcaaacaacttagttagcttttcggtcgcctcaccggtgatgttgttgcgccaagttcggaacggtaccattaactcgtcgtccttgttaaaggccatgtaaccgtgcatcatggcgctaatgccaatcgacccgattttttctagcttcaagccgtattgttcctgcacttccgccgccaattttgcgtagctagtttggattccttcccaaatcttttccattgggtaggtccagatgtggtgatccagttcgttttcccaaacgtaatccccactggcgacggtttgaaagtcgtcagtaaccaaaacggccttgatgcgggttgaacccagttcaattccaagtgccgttttagcggcggtgattttttcagcaatcaattgttgatccatgagcggttactcctttgatttattatgaattgatcctctaaacgattttattttatattttttgtccgtataaatcaatcagatctccgcattttaataaaccgttttcatttttaggcaataaaaaaaggttgagagctatttttctctcaacctcttactgtcttttcaaaccttggataacaaacacgggaaccaaccgtccaccggaagttatctcccactccccactaatttaacccatcccacagggtcttgaaggcaactggcatttcaacttcaaaggccaggttcgtttgggtaaacggatcggtgaaggccaagtggctagcgtagagggcttggtggtcggtcatgcttaggtcaccgccgtacaagtggtcgcctaaaagtgggtgacccacgctagccatatgcacccgaatctggtgggtccgcccggagtgtaagcgtaagcgcaccaaggtccaatccccccgactttcttcggcccagtactcggtcttcgccggttggccagccgggttaacctcacgttcgatttgccccttgatgcgggcgattggagcgtcaatgataccatgctccttagcaaaggttccggccacaatcgcccggtactctttttgcatcgtgtgcccctcaacttgggggctgatcatgctggaggcgacgttgtgcttagctaccaatagtagtccggccgtatcgcggtccaagcgggtaattaaatgggggcgcagatccggcgcgtccttggccactaggtagcccttcacccggtttaggatcgtcccgttgaccacgtgggggccgggaaccgaggctacccccactggtttgttcacgaccaaccagttgtcatcctcgtagacaatcgtcagtggctcttcggaagtcgctacggtggcgtcacccggctcaggttggacggtcagggtcagcggttggttcggcaaaattttggtggttggccgtacccgccggtggtcgacttggaactcgccagccccgtttttgatgtcgttgaaaagacggtgccccatccctagcgaatgaagaaaggttttaatcttaattggttcttggccccggtagacccacgtgttttccatctcggcttagctccttttttctgttgaatgtaaaaaaaccggatccgaagacccagtttttgaaaaaattatacggtccgtacgagactcgaactcgtgatctcatccgtgacagggatgcgtcctaaccagctagaccaacggaccatttaacaacaaataatagtatacgggagagtgaattcaccgtcaaccattttttgcttttttgttcaaaacaggagcgccctttcccattccccggtataatgaatggcgaataggaggagaaaaaatgagtcacctgattagtcaactcaagaccctttggggacattattcacgatacttaaaggttatctttatcatttcggtaatcctgtttgtgattacttctttgaccgggttcctgcgcgacgttaactgggaccgggtcggcgacgggctgagctcgctttcgcccttaacgatcgccctgctcaccatcgccgggattgtctctgtcatcccgatgctggggtatgacgtcgccatcacccacctcttgcctggcaagtttaccgtcggccacatcatcaggagcggctgggtcaccaacaccctgaccaacgtcgccggcttcggtggcctgctcggggcgtctctgcgggcgactttttacggccagcaggccagcaaaaaggaaatcctaaacgcaattgccaaaattgctatcttcttggtggccggtctatcggtgatgtgttgggtcgccttggtcctcatgtttggttttcaccaggggggccactttaaccgttacgccatctggctggtcggcggtggactatacttcccggccgtctttttcttcacccgctggaagtccaagagcctctttgccgacctgtcgtggcgcctggaattattgatcatcatttcctcgacgctcgaatggctaggggtcgccctcttcttcgtcttcgttggggcaatgatgggcgtccacgtcaatctggtcgccgttttcccgctttacgtggtcgcccaactgctcggggtcgtttccatgctaccgggggcgctgggttcctttgacctaatgatgatggtcgagttggtcatgctgggggttccccacgccaccactgtcgtctggttggtcttgttccgggtcttttactacttgattccactggccctggccgggatcttctttgttcaccacctctggctccagctcgataacttcttggaccacctcccgcaagcggccggtcgccaagtcgcccactgggtggtgacgaccttcatgtacggctcggggatcttaatgcttttagccgcttcggttcccgacctggccgataacaacaagctcttgcaacaggtctaccccttcacctttttcttcttgcatcagctaacgacggtggcctttgcaatcgccctgctggcttgtgcccgcgggatccaggccaaggttgctaaagcctactggccctcgctagccctgctcgtaatcggaattgccaacaccctgtggtacctaggcacccttagcttagcgatcttcttagcggtcctatttttcttgaccctggcgatgcgccacgtcttataccgtaaaaaactccagtactcgctaggtaagtttaccctcgacgccgttatctacgccggggcggtgatcttatacgtcatcgttggtctcgttaacaaccccacctacatggccaagcactcgatcccgagtttcctgctcttccccggcgaaaaggtgtggctgtcgggctttattggcatcctgatcggtctgtcgatcatgcttttgatcatccactacttcacctcggggcccgaccccttcgctggcgaacaaaagctaccggttgaccggatcaacgccctgattgaagaatttgggggcaacgaaacctcccacctggcctttttaaaggacaagaacctctacttctaccaggttgacggccacgaccgcctctttttcatgtaccggcgcaagtacgacaagttgatcgtgatggggaatccggtcggggaccaaaccgtcgtccgcgaggcgagcctagaatttctacgcgaagccaacttatacggttaccaactggtcttttacgaggtcaatagccaactaactatgctcctgcacgaatttgggtttgacttcctaaagaccggtgaagacggattggtcaaacttgccgactttaccttggccggtaagaaacaacgctcccaacgggccttaatgcacaagtttgagcgggaaggttaccaattcaccatcgttgaaccacccttttccgatgagctgatgcaagaaatgcgggccgtttccgacgactggttgggtgaccaagttgaaaagggcttttccttaggcttctttgatcccgactacatcaacaccgccccagtggccctggtagatgacaaggacggcaagttggtggcctttgccactctgatgccgaccgggggtaaggagatcctgacgatcgacttgatgcgtcactcccacgccgccccgtccggaatcatggatatgatctttgtttcaatgttcttgtatggtcaggaaaagggctacacctacttcgaccttgggatggccccactagccaacgttggtgaatcgcggtactcctttaccaaagagcgggttgcccacttcatctacgaatacgggacccatctctacggcttccaaggcctgcgccgctacaaggataagtacgctagcgagtggcactcccgctacaccgtctaccgcaagaaaaactccctgttggccaccatgatcgccctagtatcggtcgttaaccaacgtgccgatcaaaaggttgaccgccacccactaatgatgtggtggaagaaataggagtgtgacccaaccttctatataccatcaaataaaaaccgatcaattcgcaattatttgcgagttgaccggttttttacttggaaagaagtttgacaatctctatttcattttcactattacacagatagcgtggtcaccaaccgcaggcctagtatctaagtacggccgaagaacgctgcttaacacagcaaccttcggcctagcttagctatacgccctgccatacaggttggttcccacttcgaaacccaggtgcgagggcgttttattgtctagtggttgttctctaataggtaagggtagagcatttgacgacgaacctcggcagcatccacccctaaggcgtccgcaatgcaataggcaaaggccaaggccgttgccggtccccggctagtgatcaactttcccttttcatcgaccacggtaatgtcttcgtggaaacgaccgctgggagcgacctgcgtggtcgtttgctcaatccccggaaaacaagtgtagtcgtgaccatccaagagtccatagcgggcaaaggcaattggggcggcgcacatagcggcgttccactcccccgcttgttggcgccgctgcatcaattgcatcaagcgatcatcatcgcgcaatgcctttgcgccacccgagccgccgggaaagaccacgcaatcgaaccccaagagcccctcgcctacttcggctaggctagtatcgcaagttaaggcaatctggtgggcccccatcacttggcgatcatctaggccaaccatcgtcgtttcaatccccaaccggcgaaaaacatctaccggcgtcagggcctcgatttcttcacaacctggggcaatcattaccgctacttttgtcattttgaatccctctttctagctgttcacaacccgtttgatctcttcaaccgcctgctcactctccgggctttggtaaaccgggtaaatgtgatacaggttccgcccgatgtgggtggttaccgggacgtgttgctgacggagccgctccgcaaagtccatggcgtccgggtacatcaactcttcggtccccacaaaaatcgtcacgtcgcgtaagggcgacagggttccgtacagcgggctcacctgccagttacggtggtccaacttagcagcccatatcgctcctaactgccgaagaccggcggcgtttaaggtaacgtctttttcctcgtagtcagcgacccggggattagttaaatcgatgtctaaccacggtgaaatcatgattaggtgaccgggttgcggaagcccccgttcacccaggtactcgcaaaaactagccgccaacccggcgccagccgagtcccccattacggtcacctggctgaccggcacctgggtgtagacctcgttatagatctgtttaagcacggcaaaggcgtcctcaaccgtgtgggctggcaaggtcgggtaaatgggcaccaccacttttgaagcggtcctgtccgccaaccggttcaaaaactgccagtgctcctttagcggccgctcaaaaaaggcgcccccggttaggtaaataatgaccgggtgttcctgcaagtccgcgttgagcgtaaagcactggctaccggccacttcgctctccttaaccgggacggtgaacttaacgtcactgggtaattgaagggggcgttcactttccaccgccgccctttgcaatgcatcagccagtttagtcggggtggagagtgtctttttaaaaccagacacccggatcgccatttcagttagggtggcccgctgggaacggtggtggccacacttggtgacctcctttagactgctcttaatacttgtcacaattccgcgggctatttggcggtcaaagtgacgccgctttacgttcctcatcatctgcgttccccttatcaaaattttgtgtgcattcctcgtttctctctagttaaaatcctaacacggtccacgccccggtcgttagcgatttcccgttaagttttggtaaaagaagggaagtgggaaatgaccttctcgacagaccgtatgactaagctagggggaaggttggtgccttggcaccgttcttcgtccgtacttaggcactaggtctgtggtcattttccaccaccccttattgcggcatcaaatgctgttcttttagccacttcccgaaggcctgccagtcggcacgcacggtcggttctaggcgccgagcgtacaaaaaggcggccgggtgatacattggcacaatgtagtaaggggtcgtccccatttgataaccctggtgatccggccgggtttctaagaccgactggtgcaagacctgaccgtgcaagtcaccaatcttggcctctggtcccagcaagcgttggaggctggtgttgcctaggggcacaaccacctgaggggtgactgtctttaattcccagtcaaagaggggcccaaaggctaggacctcctttttggtgggggtgcggttggggtacttggtaacccgctgcccagttttcttatcggtgaccaccttaaccgagtacggccgcttgcggaccaccgaggtgatgtggacggtcgcccgcgacaaaccaatttcttctagcaacttgattaattccttacccgaagtcccactaaagggcacctggctatcggtctcactgcgcccgggggcctcacccaccagcattaccgccggatggtttggcccagcccccggtacaaagcccattaggggacgatccttgatcgctgcctctacttggtcaactaactgctgaggatactcaatttgcacgctgatcacccatcttcctatccgttatgacgccacttggtatcggttagtacccgggccgctacttgacccaggggtaaaaagaggacgattaacatcgcccgggttaaccactcggccccggtgttgaccgactgtaaccctaagttatagacggcccggtacatgtacagcccgggcaccatgattaccaccgagggaatcgtgatcgcaatccgcgggtaaccaacccggttacggacaatcgccgccaacaggccacaagctagcgcccccaagaaggcggccgggccagccgccatcccaaagtcgactaattccagccgtaaggtgttaccaagcgccccgattaccccggccgtcgccgccattttcggcgtcgaattaaacataattgaaaagccaaagaccccgcaaaaagaggccggcaaccgcaacaataagagctgccattcatttaacggcaaggcggcgaagttggctggccttaagtggaccatcagggccaccagccagccaaccaaggtcgccacggtaatgattaacagggcgtaggcggcccgctccaagccggaccgcatgtctaatttggctaggtccagccccgaggtgatgaatggaaaaccagggatgataaagagcattgccccgatgtagccggcctcgtgacgttcgttgattccccagaagttttgcagggccataaacgggaccaggtataacaaacaagccacggccacggaaacggccacgcaagcaagcagggtaatgtgacggtcaatcatcttacgccgcacaaagttcccgcaccccgctcccacaaaggaacacaacatttctaccgggcccccgccgagcaagaagacgaaggctgaacaggccaaggccgccgctaaccccacttggtaagggcggtaattacccttcatccgttcaatctcggttaaacggtggtcaatttctgcaatcgtccactcccgcttgccccgctcaatttccttaacgaacttctccagggcgtttagccgggttgtgttcaccccggtcgtcggtaacgagatcgcctgggtgtaactgtggttatcatcaatgcaggtgtattcaatcgataccaagccaatatcggccgaacaggtcattccaaggttgcgggcaaccacgttcatcgagtcgcgcacccgccaggacccggttccgcaggccaaaatcattagaccaacccgcccaacgatcattgaccgttccactaagggggcctccttagccggggtaacgttgtcatcttctacaaaatcctgccacggaatctgcatgtggtggtggtaatcttcacccaccgcttgttccttatccatctttttctctccccactttaggcactaaattacgtcctattataggagggttgccgacgtttgtgtagggacaattaagcgggtgaaaagagttccaggtgctttagagtcgtcactagggtctgctcgtcttcgcttaacacgtaaccttcccgggtcgccaccgagatgtaaaaactggccggggtcgggtccgtcaattctagcggtacgatccccggctcgtctttgatcgcatccaaaacgatcaggctgacgccgaggttttgacggaccagctccttgacccaagaaatattgggtagcgggtagagggtgctttccgggcggacacgggccgcgtcgcaataagcgttaaaggccgcccggtggatgtattggtcactgtaattaatgaagcgttcgttagccaaatcgctaaaggccacccgccgttttttagccaacgggtgttgttcgctgaccgccacggtgaaggggcgcttggccaccaggtcgacaaatatcccctcctcattaatcggcgccatcgaccccaaaatggcgatgtcaatttgaccatccttgagccgttttaacagctcgtgggacccctggtcggtgatccgcaggcacgacaacaaatccggcggacaggatttaactaacccactgatgtatattttaccgatgatcgggggtaagccgaagcgaatgctgccccgcttagcctggctaattgacttttgcgccaaggctaactggtgattgatccggtccgccgcttggtaaagtaactgaccagcccgggtgatcttcatcccccgccggccacgggcaacgtcgaccaattggacgtcaaattcacgttctaggcgttggatggcctgagtaacggttggctgggcgacgccaaattgcccggccacttgggtgtagtttttcgtttcaacaacggccgtaaagtactgtaagtcacgcgtattcattctggcgttccccctttttcctccagattttaacacaaaagggcccccacggccgtgccccaggggtcctttttaattagtaatttcatttacggataacgtgctcccaaccgcaggcctagtgcctaagtctggccacagaacaccgctggcgcgctaacctgtgccctatccttagtccaacggactgcttaatggttggatcacacttcctgatcaccacatcccaatcaccttcatccagaggctcccaatcccgatccaaacgaccaggtagaagccccccagaaccaggttcaaggaccaccacttgttttgcgggacgtaaccagacccaaacaaaaccggagccgggccagaagcgtagtgggtggttgaggcgtttaagttcccaaagaacccgagcaataaggccgccagcattggcggtacgtgagcggagatggctacggctaacagggccgaatacatcgccgttacgtgggccgttgaactagcgaagaggtagtgactgtagaagaagaagacaatcaagatcgccaagaccaagaaccaactcatcccgtgcaacatactaccgatgcttgaagaaagccacggaataaagcccagggtggtcaaggaaccagccatcataaccaagacggagaaccaggtcagggtgttccaagccccggtttcgtgcaaaacgtcggtccagctcaggaccccaacgaccaagagcaggcctaaggttaagaaggcagctaggctggcgtcgatcttggtcaggctcccggtcatccagaggaccagagcaatgatgaagataacggccattagcttttctggtagggtcatcttccccatttgatccagttccttttccgcccactgcttagcgttgggcgtttccttaatctccggcgggtacatcttgtagatcaaccagggaacgacgatcaaggaaataattcccggaaccagggcggctaagaaccagcctccccagctgatgttcactccgcttgacttggctagggtttggaccagggggttagcggccatcgccgtcataaacatggcggcggtgatcatgtccccgtgatattcggcaaagaccaagaaggagccgatcttgcgttccgtcccgtccttggggtcggagccaaaggattgggccaaggacttaatgattgggtacaagaccccaccggcccgggcggtgttggacggggtggccggggccatgatcaagtcgaccccaattaaggaataggccagccccagcgttttcttaccgaagaggcggacgaagttaagggcgattcgccgtcccaacccggtcttgataaagccccgggcgatgaagaaggccatggcaatcatccaaattgagctgttcccaaagcctaagatcgccttatccatcggcaaggtgccggtcaaaacggtcagggcaaaggcgagaattgagacacccccgattggtaggggccgggtgatgcaggcaatgatcgtcccgacaaagagggcgaacatgtgccagccggccacgggaacggccgctggcttcattggcgtgagcagccacaaaatgacccccacgattaccggccagataaagccccggtaattgactttttctaaattcttcatattgatttcttcctaatcacttctcttgtttcttactatttctgactttggtacaaggcgacttgttgaccggcttggcgcccaaagatcacgatttcggcgatcgagttacccccgacccggttattcccgtgtaggcccccggcaacttcaccggcggcaaacagtcccggaatcacgttcccgttaccatccaagacctctgtatgggtgttgatgtgtaaaccacccatcgtgtagtggatcgctggggcaatgtggatggcgaagaagcctggcttggcgatgtcgcgatccatcccggtcgtccggctaaattcctggtcatcgtggtccttgaccgcttggttccaggtcgccaccgtctttttcagggtagctggcgccatggagagtttttgggcgagctcttcgatggtgttgccggaaaccactagccccaccttgtcgtagaagtcgacggccttggcccggtcacggatcccctggtcaaagatcaggtaagcggagtgctccggcaaagcggtgatggcgttggagacgatcttacgggtgtttaactcgttgacgaagcgttgccccttggcgttaaccaggatggccccttcgccccggacgacttcaccaatcaaataaacgtgcgggttatcttgttgaacggtcgggtggacttgaatcaagtccatttgaactagctgcgccccgacgtcttcgccgagtttcaggccgtcgccggtggcccccggttggttagtcgtcttgtaatcaaccaggtctgggcggtagcgcttcatgtattccttagaagcgccgaaaccaccggtcgctaggataacgctgttggccgcgatcgtcttggtgccggccgtggtttggacttcgaccccgttaacggtcccctgatcgtcttttaacaacttagtgaccttggtctggttgaagaccgggattccttgttggccaaccacccgcaacaactcgttgaccaagaatccaccgatcggggctaagctagccgggcggtgggtccgcatcaacgacatccccccggtgatcgtgacgtcttctaacttgatgtcgtgatcggccagccagtcaatcgccagggcggagtggtgaacgaagtaacccaagaggtccttatcgtttaaacgaccgccgtcttggtaggtttcccggtaaaaggagccgacgttatcgatcaccccgtgctttaattggacgttggtttcggcggcgttcatcccggatgaggcccggttagtgttcccacctaagccttcttctttttcaaggacgacggctgaaagccctagttcatgggcttggatggcggccgtcaagccggcccccccggaaccaatgatcaccgtgtcgtagcggtcctttaactcactggccgggcgtggttgaaatttttctcccataatttcctcctaatcttgtttgtcgacgttggtcatctttaacatgtccatccattcgtcgtattgttcttcggtcaccttgccggacttcaaagcggcttcttttaaagtggagccggccttatcggcggcttgggcaatcttagcggcgtcgtggtagccgatatatggcgacagggcggttaccgtcatcaaggagttgtccaaaagttccttcatccgggcgtcgttgaccgtcaagcctgcaatcatcttgtcggcaaagccggtgatcgtcccggttaggaggtcggctgattccaagaaggcgtcgatcatcaccggcttgtagacgttcatttcaaaattcccctggctagcggccattgaaacgaccgtgtcgttaccaaagacccgtagtgacgccatcgttactgcttcggcttgggttgggttaaccttccccggcatgattgaggaacccggttcgttggccgggatgtttaattcgccgtaaccagcccgcggaccggaggccaagaagcggacgtcttgggcaatcttaaacatgtcggcggccagggtcttcagggccccgtggaccacgtttaagccggagtggttagccaagccaaagaacttgttggtcttaaccgtaaattcgtgtccgtaaacgacggaaaccttttcggcgatcttttccggcatccccggggccgcgtttaaaccagtccccacggccgttcccccgatcgccagttccaatagggtcggttggagttgctttaagtagtcccggtcgtgttctaaagcggccacgtaaccagagacttcttggccaaaggttaacggggtggcgtcttgcaggtgggtccggccaaccttaacgacgtgccagtattgttcttgtttggcctttaattcgtcaattaggtgctggacggccggcagcagctgatccaaggcttccacggccacgatgttcatcgccgttgggtagacgtcgttggaggattgacccttgttaacgtcatcgtttggcaatacggtgacgtctggattcaagcgcttagccaggttggccacgacttcgttggtgttcatgttggtttgggtcccggaaccggtttggtaaaccttaagtgggaagtccttgcgcaagtcgtcatcgggtaggactaagagttggtcaatcgcctcgatgatcaacttccccttagcctcatcaatctggtttaattccaggttggcttgggcagcggccttcttaatgttgagcagggcgcggatgatggccaacggcatgaactggccggttggaaaattgtggcggctccgttccgtttgtggtccccagagggcttcttgtgggatttgaactggtcctaaagtatcttcttccgtccgaaattgtgacatattcttcaacctccaagtatttaatccgattgcatttgtgaaaagttacacttcaaaataccccttagggttgacacttttattatttaaagtgtcaaccctaaggggtattgtacgaaaatataggtcatcctctcttaaaattattcattaataaacttgatcgcttctttaattgcgtcttctgcttgcgggtaatcccccagatggtctaaaaaggcgtgagtcatcccgttataacgaacatacttattagtgaccccttgttcatttaacttttcaaccagcacctcgttagatttgcggagcggatcaaattccccaacaattacttccactggtggaaactctgccaattgcggagcgttaatcaccgcaattaccgggttatcatcgaaccccaccttaccatagtaggtagaatgggccagtgaatcactcgtaaaggccttaaagaatcccgtcaacgcttctttaaattccttaaactcaattcccgccgttggatcttcaacggtaaccccagggacatctgggtaatataaaatgacctttttcactagcttagtttgaaaaaccacttgatccaagtaagtggtggtcattgaaagaccaccaccagctgaatctccactcacgtaaaaagtatccggcaaaatattgaatccactggcatgctcatgtaaataataaagaaccttatagattgctaacggggccgccgggaaggggtgctctggcggaagtgggtaatcaacgttaaatacctgtaaatttccaaaatcagcaaaagcccggcaaacgttatctaccgtttcaattgaaccaccatagtacgcccccccgtggaagaaaagtaacgtcgggagtggttgcccttgtgctgtagcgggccggtaacttctggttagtaccccgtcaataaccacgttttcaatgaggagttggtgcttagcgacactgtggttgggcgaacccatccgatcacgaagatcctgaatcgttggttccggttgattagccccacccgcaaatggattgccatttccaaagactgcttggaactcagcccgggtttcatcacttaaccatccgtcctcagtacggccagggaccagttttacggttaccccgtttcgaacatcgctggtctgcaaactgttaagtgcctcttgataccccatcgtcaattatcctccatttcaaccgtcaactctgaccgtgtttcactagttttgcgaacaattgccaaggctaacccattaaagagtttaacttgatcacggcgtcggtcatcttgttcaatcacgttcccattcgcaagtgcccaaatttgaccacccgcggctgaaacgtaaagtaaattgttggcgcaggaaacaaagttcccctgtttatcaactgcctttagttggtaaaggtccacttcattcccactttctaagcacgttacttcaaccttagtggggctagatgccgttacttgcgttgcttggtcaattaccttaccgccacttagcgcctctgcttttaacactcctggttcgtatacaacctgaaggtcaaccgtgttatccaccacgtcatgaatcccgtagtcatgatcattaacccaaacatgaacctggtcagcgttcgtgtaaactcgaacagcggtgttcccctgatcatcaatttccaaaagttccttattccaggttggatctaagtgcaggtaggtcttagcttggtcagcccaatgtgcttgataatagtaataatcattcttggggaatccacagatatccatgatcccataggacgaagtggttgccggccatcctaatggggatggttcaccataacagtcagcccccaaccaaataaaggtgcctcccatatatgggtgatccttaacgtactccatcacttgctttggcgttgccgttcccccagttcctggtgcgcccggtttttgcttgccaggtgccagattggagtacagagttccaaagctattaagcagtcccttggtatcatcatccttgaagtttccccgggtggtaaagtaactagcattttccgtactcatcattggtaaatcagggtgctgttggtgaatcacttctgcaccgctacccattagtggcgattcaggatagttaacaccgagaacatcaatattttgcaggtactcctcgttgaccttaccttccggatttaataactcggcctggaccaaaatgtgatctggatctaacttccggataattgtcgctacttgatgactcatccgccccgctggaatcgtgttcccaaccaattcctcattagacagggaccaaaaggccattgacgggtgcatccgactcaacttaaccatccgccgaaggttatctaatcgccacgggctcgtttccaacagccggttttcgttcattaacaggattccgtgttgatcgcaagcatccattaagtcaggtgacgcaaagtggtgtgcactccgtaaggcattaatccccgcttccttaaataaccggagcttataatccaacatctccttagtctgggcaatccctaccccagcaaaatcctggtgataacaaattccgtgtaattcataacgttgtccgttaaggtaaaaaccgtctttctggtattcaacggtcttcacccctaattgcttaactaactgatcgccttcaagttggaaagtaactgggtacatatatgggtcttccggggtccaaacatggggaccagctagctcaaccttagtcgtaatcactgtctgatcaccggccaaaagcgtcgtcttagccaacgaaacttgttgctcaccaattagtacggttggtgttaccgttacctcttgctcaccatcgttaacaacgccaacgtttacctgaagactagctgaagctgaggtcaattcgataactcgtacccaactttcttcttcagaaaggtgaacaccgttataaacctccaaccaaactgagcgataaataccggccccctcattccaccaaccttcggccccgtggcgagtatccgtttttaccagtaacgtattattcccctcatctccataacgactaagggctgttacatcaatatcttgggcaacgtacccactttcgttatgcttgaggtaagccccgttgtaccaaaggtcgctcacccctaaaattccgtctaagtgtaggtgaccctgtcgtccccgaatcccttcatcaagtgaaaacgaacgccggtaataggcaacgcaatcgtctttaaatccattcatcgttaacgtagggttatttgtatatgggagatcccgtttccaatcgtgtggcaagtcgacttttttccaactagcatctaattggctatcaacatccgttccggcaacaatggctaaccctttctcttggtctccttgaccaactaagcctaagaaatgagccccactagggccaaaaggcattcgttcccctttttcaccatcaattggagcagtaaatccccctaaggataatgacttcatcgataaatgccgcggttcgttaatctctcctaagtgaaaactccaattgcggtccaaattaattacctgtcgtttactacccattgtgcatcctcactttctgtattgctcaccagttatttgcgtcaacgtttttccttgcgtttgtggtgtccaaatgattccaattaacaatgaaattgccagtaagatcagcatgagggtccctagcaatgttaacccatacttggtcaacaaggttggaaataccagcgaccaaattccagaggaaccatacacacaaaagaaggttaccccttgagaactcccccggtacttagttggaaaaagttcgcttgaccaaagggagtaccaagcctgagctcctaagccggctccaagcccccaaagaagggcgaagaagattaaacacgtccaattcattccaccgtaggttaagattacccacgcaagcagctcgctaatgcttcctaaggcaaatagtaatcgttgactgatgtggtcacctaacttagcgaataggaagtacgtccccaaagcagtgcacccccacagtaacacttgtaacatatttgcttgggcgtttgttaaccccccggcttgaacataaacgtaaggcatgaaaaaacccattgccccactaactaaattccaaaacaggtaaattcccgtcaaaaaaagaactgactttaaattgacgcggttcgtaaataattcatggtaggggtgtggcttaggcgctccttctagttggcgtttcttttgggcgagccactgcggggattcgtctagttgacgttgcaaacgccaggtaataaaggcacatactgccaagaagataaataacccccgtgctccccataccccaaaacgggaggccactgttcctagggcaaaaatcaataccggtcctagtgaccaagcaaactgggagatccctacctgactggcccgattaccatcattagcggtttctgcaacgtaggtccacgaagcgggaataccaattccaacggctaaaccggtgatcaaaaagccagttaaaaggaaggggaagttccccgcaagcaccacgatgatcacccctaagaggtaaatcaacatgtcgtaactatagataacttttcgcccgtattgatccgcaagccatcccccaactaaagctcctagtgccgccccaaatgaattggccgaaaaagctcctaataagcccacttgcaagctatttaggtttaacgcactggtccacaaggccagcccactagcaccggcaacaatcgctcctgaatttaaaaagttagtcaaggataccgtccacgtagcccggcgctgtgaattcttaagcctagccatcgttttcctctcccagcggattgcgaactacgctgtctaggaccatggttgcaccattcgtaacgtatggtccttgaagatcgccagtatttaaggccgctaaggcttcattagacaggttgattgccgcaacttcaaagcttaccttttgttctcccaacactgcctcgtaaaccttagtagcgttcgtactcgtcaccgttaatgtgcgagggagtccagctaagtggcccatcaatcggtgaaccttgatatcggcaacttgctgatcccggtacacatcaacgccaccatcattagcctgttcaagcattacccctgcgtagtgatcaacgttaataaccgtcatcaaacctaaacttcccgttgaaaggtcactttgatcagggtcgagcgttagcgttaaactctcgtggtgttccgcttgccgcaaacctaaaaaggttggggtaccgagttcagctagcgatattgtccgcccatgcaagactaactggttattagcaacgattaaatcatcgccaagcccgtcacgaagggttagccaaccatttgctaggcccttttcaaagttatcttcaaagtggctgctttcttggtgggttggcagcaattcggcgtgcttagggtagtttgacaggtcaaccgtttcttctggacgcccgttgtaaatctttggccacgtaccatcccaggtaacggggtagagtaagctctcccgaccaatattagtaatttgactaaagcccacagcagccggacgggttgctaagcaagtcaaccaccaattccccctagcgtccgtaaatagatcagagtgcccaacgttttgaagcgacatttcagctcggtcacgattagtaaacagggggttaacgcctggttcatcttcaaacggtccccacacggacggccctttaaaaattgtaatcatatgaccttggccagtcccaccttcagcaactagcaggtaataattaccatcttttttgagaatgtgcggtccctcaacgtcccgaccaccggttccataggtcaatatctttgggccgtccaaaatcttccctgtactcaggttaatttcaacctgccgaattgccttagttcccttgtcatcaatatacccggtaaattgaaggtaggtacgtccatcttcaaaaaataggtcgggatcaatccctggcacatcaacttctacccgtgaatcttcccacttaatctgatcaccaacgagggtccccttcaaaataaaggtcttaaattcagcgaagttagttgttaccacgtaaaagtgcccttcgtggtaacggatcgttgccgcaaagattccttcattagacttggaatgccgtaaatctgcttgctccggctttgtcgcaatccccggtaactcttcccagttaattaaatccttactccgagcaagggcgactcctggatagtattcaaaggtactgttaaccatgtaaaaggtatcttcaacgcgaacaatgcttgggtccgggtacattccccgccgaactggattttggtaagttaacataatttactcctttatgaatagcaaaaccgtggtctggccacggttcttgtgttcttgtcttatacctgttgggaagccttttcgatcttggtcccaatccgtaaaaccagtaataatgctgctaaagcaacacttaagattgctcctaagtagtattgggctaccccagcaccaatgcttaatgcggctaaaataattggggttacggcacctgcaattgatgaaacaagcgtgttcatagaaataaccactgggaaccgtgacttatcggcaagaattgacaacataaacggaatcgtggcattcaccatcacaattccaacccctgaaaacatgtttccgataacatgcattaccacattgttagagaacaagatgcaaataaatgacaggcagaaggcaacgaatccccacgccatcgtatcgcgcttggttaacttccgaatgtatcctaagcaaagcgccgtgataatcccaccaacgttaccaatcgcagtaacaatggcagtataaccggtcccatgtcccttagacgctaagacaatggactggtttgccatgaaggccgtcatgatgattgacatcaggaaggtaataagtaagataatccaaacgtaaccgctaagtcccttgaaggatgcccagaaagattgcttaccatcactcttaacctcctttgcccgttggtcttggggaaccataatgtaaaagaagatcaaaattacaaaggcaacggtaaaaatccagaataaattccgccagttagaagcacctaaggcaccaccgacagcagtaaggaccatcatcccaacgttgttaaatccaatttgccatcccatcacggtagcacgttcttcaccatcaaagtgttcttgaaccagaacggggccaacgttagagatgatcccaatcccgaatcctaacaagatcatgcagcctaaaatcatatttaaactgctattccaaattgccggaataataccaccaactccggcaaataaaatcgccagtaaaccgacgtttttacgggtcatgtggtaagttaaccaggcaaacagcaaggttgctaccacctgccccaattgtggaatcgttgatagcatttgaaccttagaaatcggctccttcgggaaggacttcgcaatggcggcgatcgcagcccccaccgccgaagtagacatcaccaacaggttggcgctcaaaatcccaaccgccaaggaaactttctttttatccatgactactacactccttaagaataattgcatttatcgtcgaagcatgaagcgctttcatttacgcctttaacaataattattttttcggagctttactagatttaaaaatcgcttcccttatgtcgatttctcagatctgatatttatcatgtaaactgaaatttagccactaaatttatctagaccagcctttaaacttgattttccttacggtattgactaggtgacttccctaaaatttgacgaaacaccttataaaaatacgacggattctcatagccaactttttgcgcgatttcatcaatcgaggcggttgtgtagattaaatactttgctgctacgtttacccgttggagctttactaatttgataaaggtcatccccgtctgcttcttcaacaattcggagaggtaattgggattaaaactgaactcttgggctaactctcgcaaagtgaccgttgcgtaatttttctcgatgtacaataaaatggccatcaaattcgtccccgcttgcttttcttgattttgatcgacctcatttggacgttgatccaccatcatcgttaacctcgtaaacacttctaataggtcgaggcgaactagctggtcactcaattgtccccccgtgtagtactccttaacgatgtcatcaattattaatgggattacacgatcattactagattggtagtagccataccgtccttccccgtagctttcatccgcaagtaacgaaaaaataatcgaggttaagccccgttgattgcggataagatccaggtcgttaaacgaaaacgccgcttggcgaatttcgatgctaaccaccagggtgccatccggtactttcttgacggtatggggagtatggttccccacaatcagtagatccccttgctccaattcaattgttctagtcggtaagaccgcttggcaacttccccgtaacgggaccgttatttcagtatagttatggatgtgaaatggaactgtcgaattaacgggctgtattgataggttaattaatctagggacaatttctaacgttccatttagcgtttggaagaaacgataatacggtttcccatgaacctcccccgctcgttgaggcttcattaaccgctctagttttttccaatcacgaggacggctctcctgataaagttggtgttgaatatccaaatcctgcatagttctcctcaatatccaatctgagaaatcgacatatttttgacattttttggcaatggtatgttgttttctctattactataatgtaagcgtatccatcaaacaataaaaattttgggaaaggatttatccacaatgctagatttaaccgcaaaaccttattcattaaccgctgaacaaatcaagtgggtccacgaaatcgtagctcaaatgagtacggaagcaaaaattggccaactcttcttcgtaattggccaagatgaagaccaagttaacttaaatgactttatcgctaagtaccagccgggtggaatgatgtaccgcccagataaggccgaaaagattcgccgtgaacaattaactgccaaccaagcaagtaagcttccccttttctttgccgctaatctcgaatcaggtgggaacgggattgttaacgaagggacctggtttgggacaccactacaaatggccgctactgacgacccgaaagccgcccacgatttaggggccgtctcagggagtgaagcccgccaggttggtaccaacatgtcctttgcccccatcgttgatattgacaagaacttccgtaacccaattatgaacacccggaccttcgggagcgataagaaccgggtcattaaaatggtcgacgcccaacttgagggacttactgaaaaccaaatcatcccggtagttaagcacttcccaggtgacggggttgacgatcgtgatcaacaccttttgagctctgttaactccctttctgctgacgactggatggaatcatacgggcaaatttaccaccacttaattgataatggggtccccgccgttatgattgctcatatcatgcaaccagcgtgggaacggcgccttgaaccaggaattaccgacaaggaccttcgtcccgctactagttctaagttactcgtcaacggtctcttacgttcagtattgaagttcaatgggctagccattactgatgccactccaatgattggttacaacgccgccatggcgcggaaggacttgttacctgcaaccattaatgccggtattgacatgatcctgttcaacaaaaacatcgacgaagattaccaatttatcaccgatgctgttaacaacggggtgatctctcaagaacggctcaccgaagcggttactcggatcgttgctactaagcttgctcaaggcattatgaacgaagattgccaagcgacctttgaagttccagaaaccattaacctgaacttagaacagcaccaaaagcttgcccaagaagtggctaaaaagtccgtcaccttggttaaggaccgtgatcacctgctcccgatgaccccacaacggtacccacgggtacggttagttgtactgggagacgaggacgatgggggcttcaaggaagggggccacgttacacaactgtttaaggaacgccttcaaaaggctggctttgaggttcccgtattcgatcacaagtaccttgacttccatgaaatatttgaagaaggggtggccgatgccaagaagaagttcgacctagctctatacgttgccaacgtcgaaacggcaagtaaccaaactactacccgcctcgactgggtacacctaatggcagctgactcaccttggttcatgaagagcattccaactatctttgtttcaacggctaacccgtaccacttgtacgacttaccgatggtttccaccttcattaacgcatatacggggaacattccgagtgttgacgccgtgatgcgtaaacttcaaggccaagaagaattcactggtaagagtcctgttgatccgttctgtggtgacttcactacccggttgtaatttaacttagaaaggacatgcaaaatgaccattacgacccttcaaatcaatcatcaaacggcccccattggctttgaccttagtaaccttcgcgttgacttttccgtcgatgcagctagttttgatcaccctaccaaagccctagccgtttggacaaacgaccaagcacacccattttatcaagtggggccagttgcctttgataataactactttgacttaagtgacctcgcccttaccccacggactcgctatcacgtagccgtaacggtggtgaatgggaatgaagaaactagcgcaaccaccttctttgaaactgggaagatggacgaagccttccaggccaactggattgctaacgataataagaatttacaaaacaccctttttaagcgcgaattcaacttaggccaagaagtctctactgcccgtctctacatcaccggattgggactttacgaagcatcccttaacggggataagatcggtaacgaataccttacaccaggggtaaccgcctacgaccaactagttcaggtccaaacctacgacgtaactgaccaacttcgccaaggagataacaagttactcgtttctaccgctgacggctggtataaggggaattacggttttgatggtggtcaagataaattgtatggtgatcaacaccgaatcattgctgagttgcacgttaccttagcagacgggaccacgcttcaaatcaacacggacaatcagtgggaaaccacccagggacccgttaccaaatcggccatttactatggtgaagactatgacgcccagtttgaaattaccgggtggcaaccagtaaccgtcttgaactccactaagaacgtcctcaaagaccggttaagcttgcccttaacggtccaagagaccattaccccaactgaaatcatcacaacccctgcgggtgaaacggtgatcgactttggtcaaaatcaagctggttggcccgaattctactgtgatgaacctgcgggaaccaaaattaccctccaagcaagcgaaatcttacaagagggtaacttctaccgcggaaacctccgggatgcccgcgccgcttttacctatgtttctgacggcaaggcaaagtgggttcgcccacactttacttattacggttaccgctacatgaagatcaccgggaacacgaaacctgttgcaattaagaatttccgggcagcggtcatttactcccaaatggaaaccactggggatattgaaaccactaacccacttgttaaccgcctcttccaaaacattcaatgggggcaaaaatcaaacttcttcgacgtaccaactgactgtccccaacgtgacgagcgcttaggctggaccggggacgccaatatcttctcaaacacggccgccctaaacatgaacgtattcgccttctttaagaagtacgctcgtgacatggcgattgagcaaaacgatcatggtgggatgcttacaatgtacgccccgaaaatgaattccgatgatgggggagccgccgtttggggggatgctaccacctttatcccgtggaacatgtaccaagattacggcgaccccgccatcttgcatcaaaattatccggaaatgaaggcttgggtcgactggatcacttcccaaacaaccacccccaacctctggacggacggtttccaatttggtgattggattgctttagacggggaaaatccggcgctaccaactggtaaaacgaacgaagattacattgcctccgtttactactacgcttccagcctcatcgttagccaaacggccgctctgctcggccacgacgacgatgctaagcagtacggtgagcaagcagccaatataaagcaggctattcaacgtgaatacattaccgcaactggtcgcgttgctattgatacccaaacggcttatgcactagccctttactttaacctcgttagcgatgatctcaagccacgggtaaccgcggacctagttgcacgattgggtaaggatgacgaccacttaaaaaccgggtttgtgggaacgccgttcatcaaccaggttctatccgccaacggctaccacaagttagctaccaagatcttcttgcaagaagactatccaagctggctgtacgccgttaagatgggggcaacgaccgtttgggaacgttggaactccgttttggaagatggttccatgaacccagctggaatgaattccttaaaccactactcaatcggtgcagtcatggaatgggcctacaagtacgttttgggaatcaatgagcacacccctggctaccaggaattcacctttgctccacagtttgattaccgactcaagaaggtccatggtcacttccaatccagttacggtgatatcaaggtcgcttaccaaatcgaaaccgaccaagatcacaccatccaactgtccttaacggtaccgtttgggagtaccgcccacgttaagttaccacgtagcaatcaggcagtcgtccttgttaacgggcaatcagtccaaggtggctcttttgacttaaccgtcgggacttaccaaatcagttacgttcccgaccaagactacatcgaacgttacactgcagacacaccaatcaaggtcctaatgcaagacaaggaattgattaaccaaatcgataccatcgaccccgttttaacaccctttgagcacagccaagagatggttaacggtggccttggaaatatgagtatccgcaaggttacccagatcattccaaacattaacatttcagaagaacacctacaccaagtcgaagaattgcttacatctaccccgctccaaagcgagcgctaggcttggtgaatcctcctctttaatgcaaactaaaaggcggcccccaaccgggagtcgccttttgtcattccttaataaacttcgccgcttctttaagggcgtcttctgcttgaggggcgtagccgacttgatcgacaaagccatgggtaacgccgttataacgtaggtgggtcaccgcaacccctgtttgccttaggcggtccactagcttttcgttggacaagcgcagcgggtcaaactcgccggaaatcaccagggtcttgggtagacgttcgatgcccggggcgttgatcaccgcaatcaaggggtgctctaaactaccgaccgtcccaaagtacgacccccaggctaaggtatcactggaaaaggacttaaaaaaggcccgcatctgctcgccaaattccttgaactcgatcccggcactggtgtcttcaatctgggccccgggtacgtccgggtagtttaagaccagcttttcaacccagttagtggcaaaaaccacccggtctaagtaggcggtcgtcagcaccagtcccccaccagccgagtcgccagccagcacgaaaccagcgggcgtcgtttggtaccagtcggcgtgctcgtgcaagtagtttaatacccggtaacaggccaggggggccgctgggaaggggtgctcgggggccagtgggtagtcgacgctaatcacttggcacccggcaaaattggccagtgcccggcagagcatttcggccccggccacgctcccgccgtaataggcgccgccgtgaaagtacagcaccgttggcaacgtctgccccgccagcgcggccagccggtatcgacgggtcgctaccccgtcgataaccaggttttcaatttgcaacgggtgcttggcgatgtttttctttaaaccaggagcgcccatcatccgatcgcgcatgtcttggatactcggcttttcaaccgcttgagccggcgaagcgttaaatacgggcgccaagttcacccgggtttcgtcgcttaaccagccgcccgtcgtcttgcccggcacgaacttaacggtcatccccgcttgtttttggccccgctccaagctggccagtgcttcttgatagtccatgtctcctccaatcaaaaacgagcgaccacataggggcgcccgtcagttaattattcagcgatttcaacgtcttcaatcacgacgtcttcttctgggcggtcgcggaagtcgcgcttaacctgggaaatcttttgggccacgtccatgccctcgatcacctggccaaagacggtgtggtggaagtccagccacggcgtccccccctcttggtagcgggcgattacttcgtccgggtagccggcggccttcatttggcccaccatgtcagccggcacgttttcgttggtcacgatgaagaattggctcccattggtgttaggaccagcgttggccatcgaaagggcccccttgaagttaaagagttcctcggagaattcgtcttcaaaggcttggccgtagattgattcaccaccggccccggtcccggtcgggtcgcccccttggatcatgaagtccggaatcacccggtggaaaattacgcctttgtagtagccctgcttggccaactcaacgaagttcttcaccgtcttgggtgcttggtcggggaacagttgtagcttgatgtccccttggttagtcttaatggttgcttgaacggccttgacgtcggccaagttcagttgcggatattggctcatctttttcctccaaaattagtattagggtatattttaacacaataagggaagtgcgaaccaaccattggcaggccgtgggttaaggatagaccggggattgatgcagtacgcatcgttctccggttagacttagccacgttatctttggaatagtcaagatacaacaaaggcgccacatggttttgcgacgcccttgtttagaagagagatgttgagatgtttagtttttaccaacgacggcgatcaggtcatctccggtctgaaccgtcccgtcagcgagctgtttaacggcactgtagttagcggtgttggtaattacaatcatggtcgtggtgtcgtagccggctgccttaacggcatcaaggtcaacggtgcccaaaacgtcacccttcttgactttttgaccctgcgctacgttggaagtgaagtggtcaccctttaagttaacggtgtccaaaccgatgtgaatcaagatctcggcaccgtccgtactggttaaaccgtaggcgtgcttcgtggcgtaggccaccgtgatctcaccgtcggccggtgcgacaatcgtcccgtcacttggaacgatggcggccccgtcccccatcatcttttgggagaagacctcgtcgttaacctgactcaaatcttcagcggtcccacttacgggtgcgcccagcgtttcggtcttagcggcttcaccacttggttggttagcactagcaacagttgctacggcttcgtttgcttgggtcgtagcataaactgcatcagcgtcggctgcttcaacaaccgggtttaccaagtaattgtgcgtcttcccgtaaaggaaggtgatggtgaaggccaccacgaaggaaacgagttcacacagcaggtagaacggaattgacttggctccgatggataagaacccaatgaacccggccgaccccatcgaaacggcgatgacgtggaagagaccggctagagtagcggcggtcgcagacccgatcaaggcacagaagaatgggaacttgagcttcaagttaaccccgaagagggctggttccgtaatccccagtaaggcggaaacggcggcggaactagaaagccccttcatcttttcgttcttggttaagaagtaaacggcggtcgtggcagccccctgggcaacgttagccatggaagcaacgacgaagataaagtccccgtaaccagtcccgctcttgtaggcggtcaccagctgagtttcgatggctgggaaggattggtggagccccgtcaaaacgattggcgagtagatggccccgaagatcccggtcccgacaaagccgagggtcgagtaaagccaaacgatcccgttagtgattaagtctgatagttccttcataactggtccaaccacgataaaggtgatgaaccccgttaagatgactgacagcagtggcgtaaaggtgaagtcaaccgcggatggtaacttcttgtggaaccacttttcaaagattgacaggatccaaacggcggctaaggccgggatcacttgcccagtgtaagattggatgttaacggtaaaaccgaagaggtgccatgcacccccctctgccaaggccggcgccgtcatcatcatcccgactacggcccccaagaattggttggccccgaagcgcttagccccggaaacccccactagaatcggcaagaagacgtacggagcggccgacataacgttgaccattccttccagccccttgatggccgggaacatttggacgaccgactttggcccgaacagaccttgggaaactaaaacgttatctaaggccatcaacagacctccggcaaccagggccggaatgattggcacgaagatgtccgacagcaacttaatgaaggccatcacggggttgaacttttggttcttggccgcgatttgcttcaagtcttcggtcgaaacttccttgagcccagtctgcttgatcagctcgtcataaacgttgttaacgtccccaggtccgatgatgacctggtactggccgttagtcttgaaggtccccttgacgccgtcgttgttgtcgagggccttttgatcgatggcctcatcgtctttgaggactaatctcaaccgagtggcacaatgggccgccgcaacaatattatctgccccgatggccttgatgacatcggtagcgacttgcttgtgatccataatcgttcctccatctgcaagtatttgataatgcgaacgctttgtaagcgcttttctaccttatccatcatacatgactattttaaattgtcaaccgtttgacatattttttgaaatcgctaccaattgtgatttgatcacaagcccgttatgacggcatttcaagcacgtaagcgccgtcaatatttcctctgctaacccgtttcagagcctggtcagcctggttaaatggtaccgccgtgaccgttggcgtaatccccaaccgatccgccagggtcaagaactcctcaccatcgcggcgggtgttagattcgacgctagtgaccgttttttcgtgaaagaggtggtcctggtaatttaagctggggacgtcactcaagtggattccggctaaggccagcgtcccgttgggggccaggttagccaaggcgttaggcaccatggcccccgccggcgaaaacataatggccgaatcaagcgggaccggtgctcggtcataggccccttgcgctgaggcacagcccaactccagggcaaacttttgggcgtccttgccccgggtaaagacgtgcacctcgatcccctgcttaatcgctaactgagccgccaggtgtgcggagccaccaaagccatacagtcccaaacggccccccgccggtacgttagcccgcaagagcgcccggtaaccaatgatcccggcgcatagtaggggcgccgcttccacgtccttaaagcgggcgggaatccggtaggcaaagccctccggtaccgttacgtactcggcgtagcccccgtcgtgatcccagccggtgtacagcgagtggggacacagattttcgtgtccactgcgacaataacggcagaccccacaggcgtggcggaaccagggaatcccgatccggtcaccaatggcgaaacgctgggtgctagctccactagcgaccacccggccgacaatttcgtggcccggggtgacttccggttggtggacggggaggtcgccttccgtcacgtgtaagtcagtgtggcagaccccacaggccaaaaccttaaccaaaacctctccgggcgccggggtcggcaccggttttttaaccaattgcaggggacagggatcactttcaatcggggcggggacttttaccgcccaggcccgcatttgttcaggaatttgttctgacacagttaccactccttttagtttaattatgtttattatagtgcaggattaggagaagtgcgaacccacccagatactacttatcaagaaggtggtttgctattccacagataacgtgctccccaaccacaggcctggtgcctaagtacgggcaaagaacgccgctagggcgacaaccttttgccctagcttagtcatacagcctgtttaataggttggtacacacttccaaagataacgtgctccccgaccacgggcctagtgcctaagtacggcccgtttgataggttggtacacacttccaaagataacgtgctccccaaccgcaggcctagtggctaagtctgaccacagaacaccgcgttccgcgctaacctgtggtctatccttagcccacggcctgccaatggttggtacacacttcctttatgccaatcaattgacagcggttgtgcaaggaccctaaaataggggtaattttacaaaaggagcctttaaccatggaatggacccgtcaacaacgttaccaatcctacgatcactacaccgcccagcaactcttagaattgcaaagccaagccgccaccgacccggtgcaggtacgctaccacttgcaccccagtttggggcttttaaacgacccgaacggcttttcctattttaacggccagtggcacctcttttaccaatccttcccgtttggcgccacccacgggatcaaatcctggatgcacaccgtttctgaggacctggtccactggcgcaacctcggcttagccgtcgccccggacaccaagttcgacagccacggggcctactccggttcggccaaggccttcggtgaccggctcttcttaatgtataccggtaaccaccgcgacgccgactggaaccggatctcttaccaggtgggagcttggatggacaaggatggccaggtcaccaagctggaccacgagctcttcgttaacccgccccactttaccgaactccgcgacccccagctcctagttaaagacggccattactacgcgctcttaggcgcccaacggaccgcggataagaccggcgtcgtcgacctgtgggaaagcgaccaactggaaagcggctggcacgaagtcggtgaagttgacctggggcaatcagacctaggttacatggtggagtgccccaactacgtcgacgtcgacggtcgggctgtcatgatcttttgtccgcaggggctggatcaccaaacggcgccctaccaaaacatttaccccaacatgtacctgaccggtcaagactttgacctaacggcgccgcgcctggttaacccggacgaaacgctcaccaacctggatgagggctttgacgtttacgccacccaagccttcaacgccccggatggcactgcctacgccgtttcttgggtgggcctgcccgacaccacctacccaaccgatgaccacaactgggccaacgtgatgagccaggttaaggagcttcattaccgcgacggccacctctaccaaaccccggtggaagcaatggccgacctgcgccacacccaccacgccaccatcttcaccggtcagccaaccgtgatcaaagaagacgccggccagcagttcgaactccaggtgacgatcgaaccaaaccaggccgggaccctgaccctagctggcgaccagagcctagagcacggcgtcttcctgaactttgacaccaccgccggccaactggtaattgaccgcgccaaggccggccaaccggtggcagaagaccacggcaccacccggaccctaaccgtcccgggccaccaagaattaaagctcgacatctttgttgaccactcgctggtcgaaatcttcgtcaacgatggttacaaggttgccactttgcgctactttgccgaccaagcccacggccaagtcgccttcactaaccccaccaaggccaccgggaccctgtggccaatcaagccatactaaagaggtttgcccatgctcgttaccgatctcttcaaccaaaaccagctcagcccccacctctccaagcaggccctctttgacctgggggtggcgcgccagcaggccgttccgagccgcgaactggccgcctacgtgccggtcgatcgcaaccccttggacctgattgcggcgaccgaatcgcagatgctccccgacctcttggcgctgcgccaccagcgaatgggcgtctcgccctttacattctttcgtggcaccgccgagctgatggaacacgacctagccgaacagagccacagcggcatccaagtgatcatttccggcgacgcccacgtcaacaactacggcttttacgcctcgccggaacgtaagctcttgtttggcctgaatgattttgacgaagcccggattggtaactgggaagacgacctcaaacgcctcttggtttccacctacctggctggtcagtccaacggcttttcggaacgcgacctcttgccgatcctcaccaacgtaaccaggacctaccgccacggggtcaaatatgccaacgccctgaccttgccggagcgcttctacttctcctacgagatccatgacatgatggcgacgatcgaccggatcagcgacgatcaaccccacaagatcagcaccatcttggaaaagattctcaagaagagtccccagaaaaactccgaacaggtcatcgccaagctgacgaccgcggatgaagaggggcgccgctactttatcgaacaagcgccacgagccaagcgtgttccccaagccatcaaggaccaactgatccggggctaccaccgctacttgaaaaacacccgcgaggacgtccgcgtttacctgaccaactttaccgtggacgacgtgatccgctacgccgtgggggtcggctcctttggcacccactgttacctgatgctgttatccggcaacgacggtagccacctggtcttacagatcaaagaggccctgccgctgcgggctagcctaaccagcttgagctccgaccgtgacctgcggctggcccaggaacgctcggccggccgtcggatcgtcaccgcccaaaagaccctccagtcggcctccgatcccttcctcggggcctcccactttggccaccgctcctattacttccgccagttccgcgacatgaaggagtcgatcgacgtcgccaagctcgacctggagtcctttggtatttacacggccacctgcgccttcttgttggcgattgcccacttccaaagcccgaccgccccaatgatcgcgggctacttgcaccaccaaaaactagtcgacgataccctggctgattgggccgttcagtacgccggccaagttaaccgtgattaccaaatctttatcaattactaaaaggacccccgcaccgttcaaattgaacggtgcgggagtcctttttagttcctcaatgttagacaggacaaatgtttagatttgcgcaattgttgattcctgcataatcttagacgatttcacagataacgtgctccccaatcacaggcctagtggctaagtccagccacagaacaccgctggcgcgctaacctgtgtctaggccttagcccacggcctgccaaatggatgagtcgcactccctcttccaacggaagccaacccctacaatatattgatttagtcctctaatttggcgatttcacgttccagggtcttggcaaactcctcggtggccggcgtggtccgttcctcttgccaaaagaggtagtaatcacggtgcaccaaggtcccccccgccccgtggagcggcagtgacttgatcatcggtaagtttaggtttcttgagctaaccaccccgagctgatcagtaatcatgtagccccggttggcggccaccatcgtgtaggccccctctagcgtttgggcgaagacgaagtcgctcttgatccccagcgtttgacggtggtaattagcctcttctttttgctggctctccggcgcgatcaaaatgcaggcctgatcagttaggtccgctctgccgaccgactttttgctggccagcgggtggtggctagagaagaggatcatcaggttggtggtgactaacttgcggttaatgtactcatcggacagggcccggcgttggtcggaaaagatcaggtcaaccttttcgtcgtttaagaggtcgtacaactcctcatggttaccctggcggaggttgatctgaatcttaggaaagtgttggttaaaggtgctcacggcacgggcaatgtcgatcccggcgtattcacgtaagtaaccgaccgtcaggtgcgaaatctgacgctggccaacgatggtcgtcgccgcttctaattgagccgccgattccagtaagtccggggcgtggcggtacaggtattctcccgccgacgtcaaagaaaaggaacggttgtggcgttccaagagttggacccccagggaattttccaatgcttggatctgctgtgagatcgcagactgtgagatgtaagccgctgcggctgccttagtaaatgatcggtattcaacgaccttaatgaagtagtcgagttgttttagtagcatacaaacctcccccaatttcataaaaaacttgggtaactattctttttttagttccttcagtgcgtctttgagttcttttttcttatccttggttaccagcgggtaggctagcggcaggtgtgaaatctggtccactagcgcattggcaacgatgtagcgcgatgaccacttgtcatctgacgggattacgtaccaggggctgtccttggtggccgtggcctggatcgccttttcgtaggcgtcctggtaggcatcccagtactggcgctcccgaatgtcggcggccgaaaacttccagttcttatccggaatttcgatccgggcggcaaagcgggcgccctgctcttctttggaaacgtgcaagaagaactttagaattttaaacccgttgcgggtcaggtaggcttcgtaatcacgtaagtcttggtaacggtccgcgtagaaactttccttaatatctttaaccttttcgatgttgggcaggtgttcgctcaccaggatttcggggtggacccgggcgatcaaaacgtcctcgtaataggaacggttgaagatcccgatttgtccccgctccggtagctgctggttgatgcgccacaggtagtcgtgcaggatttccgtcgagttgggttgcttaaagttggccaccttgacgccgaccgggttgaccccggagaagacgtgggcgatcatgctatccttaccggccgcgtccatcgcttgcaaaacaataatcaccccgtaggtccgctgggcgtacaagatcttttgtagatcgcttaactgcttagtacactcccgtacccgctttttcagctcgtcggttgacagacccaggtcgacgttggtcggtgcctttttgattgcaaagtgatcatcacggtagcggtactgacggtagtccattctacttcccccattcaaaaaagcttgttaaacttacagtgaacaaccactacaccataaggaggtcgccatgtcacaacaaccatccgttacttcgtggcaaaccactgttcaacggcaagtcgaaaatggccttcccaagggttttaccctcttagctgctcaccagtcgaaggggagtgaaagtttgtacttcactgttttaaaagagggggtcgttttcgatttacgtttatcataccacccgaacgcccacccggtgaacggcttaattgactttgacctgcgcgcttttccgggcaaaaagtccttgttaaaagcgatcgcaggcgccctgtcaaaccggaccaatggccaccagttaagctatcacgattttgtcgccctcgcctttgttgaaaaggttagtcaagccagcggcatctacttagtcgcacaagaacacttactgtgcgccctttcaattccgcccctgctggaggcaaccctcttggaccagtgggcccgcaagtggttgctagttcgcttcagagacggtcagctcctcttatcgcacaccggaatggcgctattagaagcctactgggaaattgccgatgtcttcatcgacgaaccgatctgggatgacaacccccggatcgaaagcccggccgagttgattcatcatttttcctgatcatcgcttatcagattattattacggtcaacgtccccatactttgtgtgccgtcgcttccgtccgttgcgaacgtagtcatcttcggaagcaaagatttgtaatagatccattaagttttcgcgtaagcgtttccggatccgtttccaatcagccatctctcgccccactttctatctacttatcttattataactaatctagcgaaaaataaaaagttcccgctcaaaaacgggagctttaattttaatctaagacatgttttcgttcagcgcgactatagaagatccaggccacaatgccgaagaagaccggtccaaaggcggtccaaaaggccgttacccagtcgccttccagtagcggttcgacgcaggtgaagacgatccccacggcgataactaaccaaacgatcgtggtaaccacccaggtggtggtcatgctcttgtaaaagacaaaggggcggtcgaggtcctttttcatcttgaagaacgggaacgccccgatcaaaaacaggtacggtgccgaagaggaaacgttcatcatatcggtcaaaatcgtgtagaaggtcgccgccgtgctccccccaaaggtaatgaagaagacgatcaccgaaacgacgatcatttgcatccacatggcaaaggccggcatccccgccttgtttaagctcgttaacttgtccggcaagagccgcgggtcacacccctcgacaaaggacttgatgggcgagtaggtcatgacaaaggcggccccgagcccgccgaagacgtcggacagggcggtaatttgcgagaagacccgcccgagcgtcactgaagcggcgtggcttaagcccaggtggctaccggctacgagccccatgttattgatcaaaacgtattcaacgttggccaggtcaacgcttttcttgcccaatacctcgtgccagttggtggtcaccccacacatgaagatggcgagaacgtacagcaaggtcataatcaccatcccgatgatcaaagcgcgcgggaaggtccgctccggtttgtcaaccgagtcgatcaccccggccatcgtttctagaccaccgtaagcaaagagggcgtagacaatgaaggaaataatggcaattggcgatataaaggcgctgttgggtgacttgataaagttgaccgccgtgaccggttcggctgtggcgccgtgatccatgacccagatggctagtgaagccaggataaagactgcggcaatccccagggtgaagaccccgcagaccgaggcgaccttggcgatcttgtcaatcccacgactggacaggtaggtgacgatcgccaagaaggaaatttccatgatccccagcgtttggttcgaaccgaggcccaagaggtgccaggtctgggtcttgtcgcttccaaacaacatcgttgaaatcgacacgaggaagtactgggtggacgaaaccagccagaccacccaggccgacagccaaataaaggtcccgataaaggccggtttctcaccgacggagccccgcatccaagaaaaaatccccccacgagcagccttaaacgaggccccgtattcggcaaacattatcgccgacgggaggaagaataagatggcggtcacgatataccagatcatacttgcgtagcccatctggtagtaggccgtcaatgagttactaaaaccaaaaattgacgaaaagatcatcaggaccaggctggccgtcttgatcttcttcgttgaattttcttcgtccattggattaatccatcccctaatttagaattagggcaattatacccctttccgaataatctttaagtctttaatgacaatattaaagaaaagatgaactaacccttccaaaacgatgaatagtcacttttaaaaacgattatttccggctggaattctcatcgtttattaatcttaccctccactaggcagccgtcatttttcgtccctttttcgaaaatcgccgccgcatttttgggcaaatgtgctatactatctgagacgttccagattttcaacatttaaaagggagcgtggtagggagaccagaatcctgccacgctcctttttacattcccccaagtttttcttctcacttccttcgtactttgtgtgtatgattgagttctgagattcgtttaagaaagaagaattaacgccatgacacaacgtccgcaacggcagagccgctctgaggtgcgaccacgacacaggagtcatcgcttttacccccgcctctttagttttctctttattctggcggcggtggtgatgattatcgccatggtcaacggtaacggctccaacgataacggtcaatcaggaaacggccttacaacagtgaaaaagcaattacttggtgaccgccttggcgatcgcctccaacaagcatggcaaaagcagttaaacggtaccgaccaaaacgtgtcaatcgccatctattcccccacgaccgggcaaacttaccgcctgactagggcgagccacggccaccagttccacaccgcttcaacggtcaaggttggggtaatgaccgccctcttgctcgacaataacggccagttaaacgacaccgaaaacgaactggcccaagcaatgattgaaaattccgataacgacgccacttcgaccctctttgaaaattacattggtagcaaggagggtctgcaaaaagtctatgatgaaatcggtatgactcacaccaaggtacgtagtgagtgggggttaaccaccaccacggccgccgaccaagttaagttactcaacaacatcttttacaagtctgaccttttgtccgccgacgagcgccagcaaatttactctttgatggataacgttgaagaagaccagtcctgggggacctcggccggcgccgcttcttaccagcttaaaaacggctggctcgattacggtagcgaccagtggatcgtcaactcgatcggccacgttaccctgaagaacggcaccgactacacgatcgccgtttataccgatggctccagtacgatgcaagacggcgaaaccctgattgaaaacctggccaaggccaccgccaaggtcatgaaggacgcgaaggattaagtgcgagccaactcaacccaaagcaaaaatcccgccctaggtcaattctgacctgaggcgggattttattatctagaaattagcaggctgggtcgcacttcccctaacgtgctcctaaccacgagcctagtgtctaagtacgggcaaagaacggtgctggcgcaccagccatttgccctaacttagccatacagctcgtcgagaaggttagtcgcacttcccccataacgtgctcccaatcacaggcctagtggttaagtctgaccacagaacaccgcgttccgcgctaacctgtggtctcatccttagcccacggcctgtttgatagatttggtcgcacttctttaaaaccaacccttattcttgtgaaccgtcttcgtcgcgtacaccggcaagtccacgtccggggcccccttcacgtgtacccgcaggacgccgactttttcgcccttcttcacgggggcgcgcagcttgtggccgccgatcgtccgcttgtttttatccaagattaactcgacgtcggccttcttgaggctagtgttcttggctaaccacagggtggtggccttcttgagggttaagccaaccgtcttggggcccttcttttcggcgtgggcgacggtgactgattgaacgcccttcttgaagtcgctgagcttgttaacggtcaggtactggtacttgtcgaggacctggccgatcattgcgtcggtgaccttaaactggttgttgtattcccccggcaccttcaaaaccactgtgatcaagcggcggccgttaaaggtcccggtccccacgaagcagtagcccgacgaatcggtcatcccggtctttaaaccgtccacctcaccatgggtcgatgcggcggcgttttgaggcagcatcgagttgatgttgaccatttcgtactgctggctgtcggacacttggaagttgacgaacttttgcttggtgatttccaagacgcttgggtacttctccactaggtaacgggcaatcttggcgacgtctttggccgacagctggttttccgccttcttggagacgtttttcaaccgcatctcgccgaggtcaccattagcgagaccaatcatgttgtagatcttggcgtcggtcaccccggcctctttagcgaccgcctgcatcttctggttgaaggcggccgtggaccccgccgaggcaagggcgagggcttccgccgacccgtcggccgaaacaatcatcattgattccaccaaggacttaacggtgtaggactccccctcgtttaactggacgttggagaagcgccagtcgttggcgaccttagcgacctcctttgagatcttaatcttttggtcccacttgagcttaccctgttcgatgtcttgttcgatcaccgctagggtcaggattttaatcaccgaagcgatcgggtagcgcttggtggcgttcttttcgtagagcacctgacccgtttcggcgtcaatcgtgatcgccgcccgggcgtcgacggtgctgctggcgttggcgacagcgccggcactagtggtcagcacggtggtaagggtgacgaccaccaacaagaggtggaagcagacccggcgtagttttctcatcgttactctcaatctctcttctaaactttggcaacaaaaaaacggcaacgttcaccgttcccgttttatatattagcggatctgattgattaatagttattttatggaaaaccgttaataaactgtaatcttttcgcaaactaagcccgtggttcccggtttgggaagtgcatcgctactggtcgccccggttgaccgggttggttgggggccggttggcgggccgccatcttcttttgcatctcgcggatcgatgcttcccggatctgatcggcctgcttctttaagtcggtgtcgctaccggactcgtaaaccgagaactggccgacgatctggatgtcaattaactccagttcgttaggcattaagaactcactcttgagtaggctagccaggtacttagtagcgtctgataggtcttctaagcgaccaaaactatcgccgtagtgcttcatcttggcggccttctcggtgtgccactggtagtactcgttaaactggtcaacaacgtggtttaaagagtggcggtactcgcggcggaactgcgggaccccctgcaggttttcggaaatgtacttctctttagcaatgaattccatgttaaagccagaggggttttgccgaagctcctcttgggtttgcccctctagtttgggggtaatgtggaactgaattaagcgtgcgtccatgatttcacctcgttttgtattcccttcagtctactattagtgaccgggtgctgacaagggaggcgcccagttgttcatttgacttccccttactatcctttttcatctgataagttaatcaaaaaatttgctagatggtggtatgataagagcaacgctttcaggaggtactggttatcatgctcgaacactacttgattgggacctacacccaccacaacagccagggcatctactcggtgaccctagataccagcgcgggccggctgtcacccacccgcctggaaataccaattcaaaaaccgatttttatgacctttgctaacaacgggatcttgtacacgatcgaaaagctggaccaagaccacgccgccattacctcctttaaagaggaggggagccactttacccggctcagttcggtcagtgccccggggaccacgaccgcttacttggccatcgatgaagaacgccaactgctcttttcggccaactaccacatgtcgaccgtcaccacctaccggcttgacggccagggtggcatgcaaaaggccgaccaggtgctcaaagtgggggcgaccggtccccgcccgcaacaagaactcccccacgttcacttcgctaacctgacccccgatcggcgcttggtgatttgcgacttagggatggatcaggtcaatatctataacctaaccgatcaggggcaactaaaactggtcaccacccaccaggatcaaccgggctttggggaccgccatctaaccttcgggcgtgacgggcgcttcatgtacctggtcggcgaattgtcctccaagctggaggtcctcgcctacgatcaagagaacggtgaactatcgtcaatccaaaccgtttcgaccatcccggccgactggaccgcccacaacggggccgccgccattcacgtttgccacagcggccgcttcgtctacgtttctaaccgcggtgaaaacacgatcgccgtttttgaggtccaacctgacggccgggtcaagcacatccagtcggtggccacggccggcgacttcccgcgcgacttctccttgagccacgaccagaagtttatgatcgttgccaaccaaaacaccaacgatttaaccctgatgcgccgcgatccggctaccgggcacctagccaccaaccaaaccggggtaccatgcccggaaccggtgcaggtgctgtattggaagtgaaggaagtgcggaccaaccattggcaggccggataacacccagaaattcaaaacgagcgcctaagagaaagtttgcttgggcgctcgttttagttagaaaattagttggtacaacagggtgctgatgataaaccaggccccggcaaagagaacggtgccggcaacgtcactgacgtggtgggcccgcaggatgatccgcgagctagctaccaatagccaggccacgcccccgatcacgatcaccggccaaatcggccatagttccacgaccatcaggtacagggtcgttccccccagtacgtgaccgctgggaaaggaataaccatcatcatgttccaaatgggcccccgggcgttcgcgcttgagggtctttttagtgatgacccctaacacgttgccgatccctaacgtccacaaaacccaggtggcggcctgttcttcgtggataaccaacagggcgacggtcaaaatcaagacgtaaaccacgaccgcccagggttcaccgacccaggccaccaggttccaaaagcggttgtcgggctggtggggcattttagcaaaggcccagtcgtcaaagcgggcgaccagaccgtgatgggctaagtccaataagagcaaccccaagaggaccaggagcccgattaaccaggccccccagtggggaatcaccgtcacgctcactggtcttcctccttccagtgccgggttttgttaaccttcatcttctcggcgatcgcttggtaggggtcgagccccatttcatcgcacatgtaaaagaggtagatcaaggtatcggcgatttcttctttcaagtggtcgcgttcctggttggtcaacggcgtttgctcgtccttccactgaaagacttctaagacctcgcttgcttcgaggttcaccgaaagggcgaggtcctttaaattatggtacttcccccatcccttttgggcggtaaagtcgcgcaggatggtggtgatttcttggtaatccataggtcctcctaatcgataaaggtgtggtagcggttatgttcaacggggtgatccaacagaaggtccattgccaaccgcggcaccccatcttgggtttctttttggacgctgttgttgaggtaacggcaagtcccaaggtagtaaaattcggtttcatcgatggcacccgacttctggacgaacagccgcagcttgtattcgccccccatgaacttcaccacgttggccgaatctaacttaatgtcggaattcttagtgtagtaatggagaacgtggtcattgatgaagcggttattgtaattgatctccttacgaatgtttttggccttcttgtaggtgacgaagataatcgcctcttttaaccccgtttcttcactggtgaagcgataacccgacacaagctggccgttcatatcgtaagggttgttaatcagacgcacggcatcccgcctagtgtagcgttccccaatcgtaaattgttcgttggcctggtagcgttcggcccgcagtaggcccgtttcgatcgtatcagaccacagctggtaaaaccagccccgcttggtaagggcttgggccaactgctcccccatttggtagtttttttggtctggatcataattaaccagcgcaacgcccccataagaagctcgtgatgggtaggccctttcggcgtagtactggaggcttaacacccgccggaccgagttcaaggtggcttcgttgacgtaacagccagcctccttgagctccctgacgtaatctgcctccttaaccacggaacgttgtagtaataaccgtagcaaaatcaattcgtggcggcgcttgccgtttaacaattcaacggagataagggacaaagcctggtcttcgtagtcagttacttcaactggctcccccatcttaagcaagaaacggttgtagttacggggcttgaccaccgtcgctaagatctgcggatcgaccgaatccatcttcaaaaagtcgctgagcattgggattcgccccacccgtcgcttgatattttggtaggcgtcccgtaagttagccagtccgtctagtttgaccttgcttaaggactcataaatccgttccttagccacctcgtcaaaggcgatcgtcgacaggccgtcggttggttcaatgtcgacggtatcgcgagcctgatccttggagtaggaattatccccggtcaaagcaatcgggatcatgtagttatttttatagttaccaatgaagtcgaggacctcgacgtactccttacccgggtacttgcgcaatccccgccccagctgttgaacgtagacgatcgccgactgggtgttacgtaggaaaacgacctggttgacgcagggaatgtcgattccctcattaaagatgtcaaccgtgatgatgtattcgataagtccgttttctagttcgtgcaccacctggcgacggcggtcgccattatcggtaccagacagggccttggctgggtggccggcagccgtaaaggccctcgccaacgcttcagcttcggccaccgacgaacaaaagaccaggccgtgcaagaccgggccggaatagccgtagtaatcggtctgttccaggatgtagttaacccgttccttactggtcaacaattccaccgcccgttgctcttgcttacgcgacggtttgctcccctgcttgcggttccggtactgatcaacttcttcttcgtattgatcagcaaaggcgtagtcggtcaaccccacgtaatgaaagggcgccagcatgttcaactctaaggcttgttggaggcggatttcataggcgacgttatagtgaaagagattaaagatgttaaagtcgtcgctgcgttccggggtcgcggtcattcccaagaaaaactttggggtgaaatagtccatgatcctttggtagctctccgccccggcgtgatgaacctcgtcaatcaaaatgtaatcaaagtcatcgggggagaagcggtgcaggtgttcctcccgtgacagggtttgaacgctggcaaataggtacttggcgttcttgtctctggccccaccagtgtagaggccaaaattggctggatcaccacctaagatattttgaaaactctggcaggacttttgcaagatctgttcccggtgggccaagaacagcatccgcttgggcttggccgcccgaacgtcgaaggctcccaggtaagttttcccggtcccagtcgccgacaccaccagcccgcggtccttgccggccaggcgcagggcctcaatttcatttagggccgccgtttgcatttggtttggcttaaccagctgcgctttccccggctcatctgacggcgtcacgtaatcatgcaccgccctgttaacttggtggtccgcttggtaagccttgcggtagccgtccagccagtcctcactcagcggcttggcgtccctccattcggcttcaaagttttcctcgatttgacgggtgatctcaccgttattcagggagctgacctttaaactccactcgtagttttggtttttcatcagggcgctggcggttaaattagcactaccgatgatcaccgtttggtagtcgcggtgcttaaagaggtaacccttctggtgaaaacccttgacggtggcaatccggacctctaagttgtcgattttaagtagttcttcaaacatgtccggctggttgaattgcaggtaagtcgacgtcaagagccgccccttgactccccgggccgccaaggttctaaagagcggcttgaggttggagaccattgcgtcagtcacaaaggccaccgcaaaggcgtactccgtcgcgtcatttaattctgaacgcagctggtcccagatctggttatcaaactggttcgttaatagcttaggcccgaagtcaccaattggttggaccccatcttggtcaacgtaaccatgcaaaagggaggcgcccatctccttagccaggctcccctgtgtccctaactcatccaataagtgatcgtaattaacatcttgatgcattcttttctcccattaaatagacagttgggtcaagtcttcttgctcgatcaattccgcaatttgccgatccgtggcggcccagtctaacttccctaactgggtctgctcacaccaaacgaccttgccgtgcgccattagccgtaagtcctcgctagctaagcgcacgtagtaaaccgttagattcacggtcccaaagtcatactcatgcttaaaggtcggccccactgccgggcctacttgagcttgaaccgaaaactcctcctctagctcccgggtcagcgcttgctcgggtgtttcgccagccttgattttgccgccgggaaactcccactgttgaccgagaactcgtgcgtcggcccgctgcgttgccaagatttgattttggtcgtttaaaatggcggccccaaccacctgaatctgtttactcatcgttttcccccgttttctttcagtatagcaaagttaaatccggttcgattctctaccccaacatccacttggcaatcagtttcgccatctcctcgaccgactcgcggtcctctttttctagccagcgcttgatgacggccacgttaccgtaaaagacatagcggcgttgatagtcgcgctgttcttgggtcatgttcttggggtgggtcttttggccctgggtcaagacgaagagctggtcttgaaagtcacccaggttgtcttgggcaaacagtaccaaaaaggtctggcgccgttcttgcacgtattccagcaccgcctgcatgatcgactccagggaggcccgtttgtcttggcactggccgtggttagccacgctttgttgcaggtcggtaaagacctcttcttctagttcccacatcacgtccatcgggttgccgtagtgagcgtaaaaggtcgaccggttgacgtcggccttctcgcacagctttttgaccgagatttcgccaacctgccgattggccatcagctcgatcagggcttctttaatgacctgcttggtgtatttgacccggcggttttcttctttttcagccatcttttcctccttgtttccaacataaaaacgactttgtgttggttttaaaacaaattgtcgtttcttgttgtggtcaccgcttgctcccctcactataatacagccatgtcattaacacaacactatgttggaaagggagaatgaatatgacttcaagttccgttgatgtgcacggaaaaacctataaccgcatcctgctggtcatcgtggtgatgatcggatcctttacgaccgttttaaaccaaacctttttagccaccgccctgccgacttttatgcgggtctttgacgtgtcgactgcgaccgtccaatggctgtcgactggctttttgctggtcaacgggatcatgatcccaatctcggcgtggctagccgataacgtcccgaccaagcgcccctacttaatcacgatgctgatcttcttttgcggcaccctgatcgcctttcaggcccacagttttgccgccctcttagtcggccggctgatccaagccgtcggggtcgtcttacccctgttgcaaatcatgatgttggaaatcttcccggctaaccagcggggccaggcgatgggactggccggcatcgtggtcggcctagcgccggcggtttcccccaccctagctaggtacatcctggatcacggcagctggcggatcctgtttgggatgctgttgccaatcatcgccttcgtcctcttcggcgccctcttcttcatgaaggacgtcttacccggcaaacccagccagctcgatctttggtcgacgatcacctcaacgttgggctttgggagcctactctacggcttctcgaccgccggtaacgacggttggggcgacgctaaggtcctgatcgccctggccgtggggctggtcttcatcgccctcttcatccaccgccagctgacgatggagcgccccttcttggatctgcgggtctttttaaataaggacttcaccgtcggcaccctgctgtcgtcctttgttaacctctcaatggtcggcgttgaaatggtcttgcccctgtacttgcaggacttaatgggccactccccctttgaatcggggctgacgatgctgccgggcgcccttttgatcgggttgatgtccccggtcaccggtcgcctctttgaccagtacgggatccgcaacctagcgatcaccggctttgccatcttgaccctggggaacctccccttcatcttcttgagcgccacgaccccggaaatcctggtcgtcttcttgtacgccgtccggatgtttgggatttccctggtcttgatgacgacgatcaccaacgccatgaacgccatcccggtcagcgagtttagccacgggacggccgccaacaacaccttccgccaaattgcctcgtcgatggtcacggcggtgatgatttcaatcctgtccaacgtcactaaggcccacctacctggccacgccctaaagagcagcgccccgcttttgtacgccaaccgggcctttgaggcgaccctgcacggctacagcgccaccttcttgtttgcgaccctcttttccgttaccggcctctgtttggacctgaccctcaaaccaacccggaggtaatttgatgctgatcttactattaattgtcctctttggcgggagcttctttttcttcgccaacctacatccccaccgcaccggggccatcaccagcgccctcttctttagtctgtccatctttttattggtcttaaacatgggcacccacctgggtttgactaaaaccaccaacaacaaccgccaaaccattcgaccgacctcgacctcccagggagtccagctcctgggctaccagccactgggcaccaccaacaacgagcgggtttacgtatataacggcgaccaaaagtccccgccccccggcaaacggggcctggccaaaacgaccagggtcgccagttcggttaccaccactaacgctaagcacgccaccctgaccctaacgaccaccaagtacacctaccaaaaccagctcgctaaggtcctctttgccatccccggcaccaagctcgcgaccacccagcaagtcgcccacttcacggtgcccaagtcctggttggtcttgtcgagcaaacaagcgaccaggttaaaacaagcagccgctaaccctactaaccaggccaccttaaagacccaggcgaccgcctacgttaccgcccacgtccaaagcgacctgaaagcactggcggccaaggcccaggccggtgaccaagcagcgcaggctcagttggctaaccaaacccagctgacccaaagtttagcggccaagtaccaacgcgccttcacccgccaggcactcctaaaattaagtagccattaaaaaaacggggctgaggaaaccatgctccccagccccgctctccgcccgtaacctgcgtggttaactaacccctcccggtggcggaagcaccaagccggacccccatccggcttgatgtctttattattacaggcgacttggtcatatattgtcgttggccaaaaaaagcggtaaaatttttctaaaaaggatttgatcatatcgataaccgccaagccgccattattttcctcctcctaaccatcggggaggccaccaaaaatgacctgattgataagtaccatacctcggccaagacgattgaacgagatatcgccgccatcgaaacgctcctcggcgactaccttaacttagaggttaaacgggaacgcttcgtcaatgacgacggcgagcgcgacgtcaggtacctggtcgacgctagccaggggccctttttaacccagcgggaggtcttcatcatcgccaagatcctcctggccagccgctcctttgataaggaagtcgtcgaacacctcattaacaagttgacccgccccttaaaccagctccaactcgccgaacacggggccgacgaaattaacaccttgttaaagggggagcgccattactaccgtccggtggccgaaccgacccagctggcggtcttagaaaccttcctcgacgccgtctacgcccacaaaaaggtgatcgttgactaccgcaagcgcgacggttcgatcgacaaggactacgttttcaccccgctaagcatcgaacacttcgattactactggtacgtccgcggctacaaggaggtcgacaccaccaagggcgctaagggggatgaggccgacgctgcccggatcctgcgctgcgacggggtattgtcgatcaaaatcggccccgacgccaccaagcgtgagctcgagggctttgaagccgaccgtaacaccgtgatcggtatgttcaagggcaaaaaccaccagacccaaaccatcctggtcaaggccgaccacaaggccgccaaaatcacgatcgaccgcattaacgccgaggtggttggctactacgtcgaccaaaccgagttcccggcctcttctttagccgaagtgcccgatgacgcgccggtcaagttaaagtcacgcttaatgctgggcgccggcctttacctcttgctggggatttccggcatcgaagtcttggaacccaaggaattacgtttagaaattatcaaaaaactctccgacaccctcgcccgttaccagctcgactaaagattgttacgttccgcacctaatttcttgacgtcgtgtcacttacttttgtacaataaccgtaatcatccacattaacccttgaaacggaggtacatttccatggcagataaggtgtttaccctcgcggaacttgctcaatatgacggtcaggacggtcgcccggcttacttcgcttacgaaggccaggtgtacgacgcttcttccatcccgaactggaaagagaacaagaaccacggcaaccttgccggtaaggacatcactgacgccctcaagcactccccccacggggccggagtcatcgaaggcttgccagtggttggtaccctcggttaaggttacaaaaaaggcccggcagtgcgccgggtctttttttgagtgcgaaccaaccattggcaggccgtaggctaaggatagggcacaggttagcgccctcggcggtgttctgtgtccagacttagccactaggcctgcgttggggagcacgttatctgagtaaccatcaaggatcaaaaagggctaggggaaagccatctctcctagcccttttgcctttatctcgccctcactgcggagtcaagacaatgaacttataatttactggtccgcaccgcagtacgccaatggcatccagctggtcggcaagccgacgctagctagatacctattggcgcttgcgggggagcgacgacgaaatcaaagatttctgtcgctctccctactctactacatgccgttcaaacggttggtcggaaatcccctggtccaggatcgtcttggaccattccttggcggagaagagggagtggtcgctgtagttcccgcagctttcgatcgtcgtcccctgtacgtcttcccattcggtgtggtaggcgatttcttctaatgaggacttgagggccttggcgacgtccgtcgtcgagtgttcgccccaggtgatcaagtggaacccggtccggcaaccaaacggtgagcagtcaatcaccccgtccaggcggtcccgcaagaggccagccaggaggtgttcaatcgtgtgcaggcccgccgttgggatggcgttttcgtttggttggaccagccgcaggtcgtagttggcaatcttgtcacccttaggaccttcttcaaccgtgatcagccgcacgtaaggggccttcaccttcgtgtgatcgagcgtgaaactttcaacctttgccataactatcttctcctttatttaaaagttaataccacttcattatacaacccgggtcaaccatggtcaagtccaaaatgttggtgtaaattaaattccgcgaatttatcatttcacaagcttaagcataccggcttcttctgaattgtcatctttttcaatcccgtggtaaacggtcatgtttaagtaccgtggaccagcagcccatttttcattctgttcaatcagtagtgctcccattagtcgcaagacgcttagatcattcgggaatatccggattacacggtcacgacgacggatttcttgattaacccgctcaattgtattattcgtccggagacgcttccttagctcctctggaagctggtaaatcaccattaattcgtcaaaactattttctaatttcttcaccaccttagggaactcggtctgccaatctttaaccaattggtcacgccgttcaaccgcttggtcgtacgttggagcattaaataaatctttgagtcggttagcaacttctttacgatccttgagtgccagaatacttgtacagtcattactaaaatgaaattgacatctctgccaaaggctaccctgaaattgcgtagtgattgcatcctttaagccacaatgagcgtctgaaacaaacatatcaacgttggtaaggccccgctgtttaagttcactaaagaagtccatccatgcagcttttgattcactatcaccgatatcaaaaccgagcacttctcgacgaccgctagggtcgattccaatcgcaacgagtaagctattacttgtcacaacgtgaccacggtgtaccttaaataaaattgcatcggcatacacaaaagcatacttttgcgtaaggggacgtcggttaaaattcagcacttggtcgtccaaattattgcataaagccgagaccgtacttttagaaaaggttgtcccacataacttcttagtaatctcagctactttacgtgttgaaacaccttggattaccatttccattaatgccaaatcaaaggcctgctcactacgctggtagcgtttgaacagctgtgttgaaaaattgccatgacggagtttaggaacgtgtagttctagagaccctacgcgggtggtaagctgacgaacccgataaccattccgtgaattggttcgttcatccgaacgttcataagccttagctttaatctgctcagtcgcttcggacttaagaatttcgtcaaggatcttggccataattgattgcatggccttatcccgatcacctagtaatagctcctttaattcgtcatcctctaaatttaattcaacttttggcataatgaagttcctttcagatttcacaaagtcttatttagaatttacaccaattatacggacataacctcaaccattaaccccaaacttgcttggcaacttcgacgaccagcttgatcttagcccactgttggtcttcggtcagctggttcccctcttcggtcgaggcaaagccacactgggtcgataaggcgaggtcgtctaaggacacgtactggctggcctccttgatccgggcaactaggtcagctgccgcttctagctctggtttcttggaggtcactaggccgaggacgacttccttgccggccgggacttcttggagcggttcaaagcccccggagcgctcgtcgtcaaattccaggtaaaaagcggagacgttttccttggcgaagacgtacttggccaccgggccgtaaccgcccttggccgcccaggtcgagtgatagttgccccggcagatgtgggtcgacacccgcaggtcggccggtagatcaaccagtgcaccgttattgacttccaagtacttggccgccagttgttcccggtcgaagccggcgtcggccatgctttgccagaagtcgtcgtcaacgaccatcccccaggtacagtcgtctagcttcaagtcgcgacagccggcgtcgtacagggccaagatcaggtcacggtaggccgtcgccaggtccgttatcaggtcgtcttcgtttgcgtaaacctccttgagcttagcgatgttttcgtccccccggtagagttcggcgtaacactgggccggtgacgggatcgattgacgaggaactaggtcggtgccgtcggtcaggctcttcaaatacttaaaggcggtcaagtcggggtgtgcgccggtaaagcgaatcttgcccgccacttgggccgaatcgttgcgagtttcttcgtcgtggaagaagtagccgtgggtttgggtcatgtgttcgatcccaccaaagccccagaaggtgtctaggtgccagtaggaacggcgaaactccccgtcagtaactaccttcagaccggccgctgcttctttttgaaccagttccttaatctgggcgtcttcgaccttggtcaagtcggcttgactcagctggcccgccgcaaactgttcgcgtgcctccttgagggcttgcggacggaggaaggaaccaacgatgtcgtagtgtaattgtgttgtcatagtgaaaatcccctttcaattttgccaatttgcgaagccgctgaaaataaaaacgcccccgaagccacttgtgcttcagggacgcttgatcgtgttaccacccttatttgaccccacctcgcgatcgggtcctcagtgggtactccaaggaatacccagacgcaatatcgggcgtcagccgcggtccgctcaccatcgtttgcggagccggattgctccaagaccatcttcaggacctttcaccacggcggcttacacctatcccgcctctcttaggaggtttccggtccttactcatctcttctcagctgtttctcattaaattgtcattatcttaacctggtcggggggccttgtcaactagcttttttaaaagtgcagcgccctgacgcttaggcgtgggcccactgggttaagaggtcggttaactcctggtggttagccacggtcacggttggggtgcccccgctggtgttcgccacccggcgcgggttgtaccagaccgacgccaggtgggccttatgcgccccaacgatgtcggaaggcaggccgtcgccgatcatgatcgaccgttccggcgccacttcgctggtggcaaagaagcgctcaaagatgaccggatctggcttttccaccccgaccgtttcggacactaaaaccgacgaaaagagcggcgccaagccggattcactcaaccggctcttttgcaccttggcgacccccgttggtgatgatccccaattggtagcccaggcgttgggcctgcttgagcattgccatggcgccgggcatcagctcgtgttgggtccccaaatagcccaggtactcctggtcgacttcggggccgacggtttgacccagctgttccttaaagaaggtcacgaaccgcttggcaaagagctcgtctttggtcagggcgccggcttcaatttggcaccacaagctggtgttgtaacgttggtaagccgccaccaaggacggggtcggggcgatgccgtgtttttcaaacagggtcgttaaggccaccgtttcgcccgccgaaaagttcagcagggtgttgtcgacgtcaaaaaacttcttacagcagctggatcttggccttagcgcaggcttctttcatctcttctggccaaatcgaggcttggacttccccgacgtgggctttgccgagcaaaagcatgcacagccgggactggccgatcccgcccccaatcgtgtacggcatcttgccggccaaaaggtcgcggtggaacggcaattcggcccggtcggtagcgtgagccttttccagctgttctttcatcgcccgttcgtcgacccggatccccatgctggagacttccagcttggtttgcagcggttcgtaccagaagatgatatcgccgtttaaggaccagtcatcgtagtccggggcgcggccgtcgtgcggttcgccggagcgttgcagcttgtcaccgatcttcatcacgaagacgcagcccagttccttagcgatcttgtcttcgcgctccattggcgaaagctctggccagcggtcctctaattcctgggtggtcacaaagtgaatttcgtccggcaggtggtaaacggcctgcgggaacttgtaccaaacctcgtgttccatgtgcttgatgaccttaaagacctggcgtacggttgccttcagggtggcttcggtccgctcttctttggcgatcaccttttcccagtcccactggtcaacgtaaatcgagtggaagttatcgaggtcttcgtccttacgaatggcgttcatgttggtgtaaagcccttcgtgtaagccaaagccgtacttctttagggcaaagcgtttccacttggccagcgagtggacgatttcaatcgtttcaccgggcaggtccttcatggtaaaggacaccggggcttccaccccgtttaagttatcgtttaacccggtgctttgttcgacaaacatcggcgccgacatccgttgcaggttcaactccttgccgatttcatcctggaaggtttcacggatgtaacggatcgcttcttcggtttcgcggattgacagcttcgggtcgtagttttctggaacaatcaaagacatttaggttcctcctttgcctactaacacagttggacggttttatcacccgttaatcataatctaattttaacgaaggggcgctcccattgcaaccagacaaatctgccgacttttaacgctttttcggtgaagtttttccgattaatggtttaacggcccaccaccccgctataatggggaaaactgagaaaggatgattgatgtgaagaaaaatgacgacgtgatcgtcatcgtggccggcatcatcgtcagcctcctcgtcgtgctcggcgtcgggattggcgccgcctactaccaacaaacctcgctttcgcaaacccactccgctaagatcaccaccaaggagttcatcaaagaaatcgccccggccgcccaagcggtggaaaagaagtacgggatccccgcttcgatcatcatcgcccaggccgggaccgaatccgactggggacgggccaaactagcctacaagtacaataacctctttggcatcaaggccagcggtaaaaccaaccgggtgaagatgtacaccaaagaaaccctcaacggcaagaccgttaccatcaagcagtacttccaggtttactcctcgtggaaggcctcaattgacgcccacaccaagttgatcttaaacgggaccaccgataacccccaccgctaccggggcgtgattaccaagtcctacaccaaggcggcctgggccctgcaaaataacggctacgctaccgaccccaattacgcgaacgaattgatttacgcaatcaaaaagtttaagctcgaccaatacgattaaccagaaaggatcctgtctatgaaccctactttcacgctggccccggccacgaccgctgacgtcttagccgtcctagaaatcatcaaccacgccaaggccttcttgaaggcggccggctcgacccagtggcaatccggctaccccaacgccgacacgatcaccactgacatcgctaacgaggtcggctgggtgctaaaggccgatcaccaggtggtcgggtacgccgccgtcatcgttggcgaagaccccaactaccaagaaattgacggggcctggcaaaatacgaccgccccgtacgccactatccaccggatcgccatttccaaccagtaccggggccaacaccttggccagcgcttctttaagctaatcattgaccactttgcaggggggggcgtccacaacttccgcgtcgacaccttcaagctcaaccagccaatgcaacacgtggctaagagcgccggctttgagtaccgggggatcatcaaggtggtcgacccggttgacccggcgcgcttggcgtttgagttgaatttgtaggaagtgcggaccaacctcctttcaatcaattacagaagtagctgaagatccacgtttttatcgatgcgatctccagctttttcaattttcgactgttatacagataacgtgcttcccaaccgcaggcttagtggctaagtacgaccacagaacactgcgttccgcgctaacctgtggtcttgtccttagcccacggcccgcttaatggttggtccgcacttcttgtaaccgaacacttgttccgataactaaaatctgctatgataggggtgatttacgaaggggggtggcccgcgtggcccaagagcacacctacgtcgccattgatttgaagtccttttacgcctcggcggagtgcgccgcccacgggttggatcccttaaacgccaacctagtcgtggccgacgcctcgcggaccgacaagacgatctgcctagctgtttccccggccctaaagtcgtttggcgtccccggccggccacgcctatttgaagttaaccagcaagtcgaccgggtcaaccgtcagcgggccgctaagtttgccaaccggcgcctagccaagacccgctcgatctacaaggacgaactggaaagccgcaccggcctgcgggtcgatttcatgatcgtgcccccgcggatgcgctactacctccaggtgtcggctaagatctacgagatttacctccgcttcatcccgccggaaaaaatccacgtctactcgatcgatgaggtcttcatcgacgccaccgattacttggccacccaccacgaatcggcccacgcactggccaaaaagatgatccaagcgatccaggccgaatttgggatcaccgccaccgccgggatcggcaccaacctctacctggccaaggtcgccatggacatcgtggccaaaaagatccccggcgacgctgacggggtgcggatcgtggcgatgaccgaacaagattaccgccgcctcctgtgggctcaccaacccctgaccgacttttggcggatcggccgcgggtacgcccgccggctagaaaagcttggcctccacacgatgggcgacatcgcccggtgctcattaggcaccctgtcggacccgcaaaacgaggaggtcttgtaccgcgagtttggtaagcacgcccagctcctaatcaaccacgcctggggctacgaggccgctacgatcgaagacattaaaaactaccgggccagcgaacacggcatttactccggccaagtactgatgaaaccctacacgatcccccaagcccgccaggtgatcagcgagatgagcgccgacctgtccttgcagctggtcaagcgccacgctttgaccaaccagatcgccctgctcctctcctacgacgtaaagagcatctcctacgccagcaactaccacggcccgatcgtaaccgacttttacggccgccaggttcccaagcccgatcacggcggtgccaacttacccgacctcacctcttcgccccgggagctgcggggcgcctttttggacctctacgaccgcatcgccaactgggacctcttaatccgtaaggtaacggtgatcgccaatcacttagtcgatgaagaagaggccgccaaacaggtccgcaccgagcagttaaacctgtttgaagacccccaccaaaaggtagcggaacaacaaagcgcccagtcgacccgcgaccaggagcacgaggtccaagaactagtgttaaagctacaagaacagtatggtaaaaacgccattatccgggccgccgacctcttagacgggtcgaccacccgtaagcgcaacgacgagattgggggccacaaggcatgaacaaaccagcaccagaccaacaaacggcggccatcgaggcccgcctctttaaagacaccagcgcctaccaagacatcatggacctgccccggccggtctccaagcaccactggcccctaccagcggccgaccacgctggtcagttcgctccctttgcggccctgacaggctaccaccagctgatcaacgaggtcgccgagcgctacagccacaagaattaccccgatgagctgagcaccaagcgcattgagcgtaagttactggccatcaagccgctcttgcccctgcgcctcaaggtcgaatatttcaacggcgacagcggctactacgaaacaatcgcgggcaccgctacccagctcgacttcaggcggggccggctgatgatgaccagaaagcaggagtgggagctaattatcgccaacctgcggaaggtgacggtggtgacgagaaaataggaagtgcgacccaaccattgggcaggccgtgggctaaggacaagaccacaggttagcgcggaacgcggtgttctgtggtcggacttagccactaggcctgcggttgggaagcacgttataggaagtgcgacccaaccattggcgggccgtgggctaagctagggggaaggttggcgcccccggcggcgttctttacccgtacttagccactaggcctgcggttggggagtacgttattggaagtgcgacccaacctcaccagtgaatgcacactcattaagtaaaaaaagctgaagatcacgtccttttagacgtcgatcttcagctttttattttaactgtgctacagatgacgtgctccccctagtccacccggtgcatcgcttctttaacgtagcgttcggtcccgtcggccaccgcctgggtgtagtaagcgcacttgaagtcgaccatcttcatcgtctcctctagggtggccagcttggcttgcagccgctgtttgaggtcgtaaaacatcgcctggcgctccgctaaggtggcgtccccctggctggctaattccatgaaggccttgatgtctttgattgacatcccggcgtttttcaggcactcgaccacgtctagggcgccgaggttttcgtcggtgaactggcgcaccccgctggccgacttacccaagccggggatcaggccctcctggtcgtagtaacgcagggtggccacggaaaggtggtacttacgggcgacctcgccgatttggtaagtgtgttccttaattgcttccattccaattctcctcaagttaactttagatcccattttacgccaaattaagggcgccgtcaccagtgattcaccaacataaataattctattaattcagggtgattcttaacttatattaagtatcaatgagggattgctttccccaccgccccttttaagcgcctttagctttcaaatattaactaaataccatgaatggttacataagtaccgacaataacttttgacaagcaagttgaaagctggtacatttaaaattgatctcactattttttaatgaaaggaggcgccccgatggattcttaccaattaaccccactgggcgaccaagccctggtgattaccctgggcgattcaatcgacccggtcgtcaaccggcgcttacaaaccctaattaaagaaatccgccaggccaacctacctggtatcgtggccctcatcccggcttattcgactttaaccgttacctacgatggcatcgtcacaaattacgacaagctcagccacaccctcaagcccctgatcgattcctccctgagtgcccccttagccacgcccactacctggctaattccggtccgttacggtggggatggggggccggacctcgccgacgtcgctaattttgctgacctgagcaccggcgaggttgttcaagcccacaccgaccaggactacctgatctacttcctcggctttttacccggctttgcctacatgggtagcgtcgatgacaaaatcgccatgccccgcttagccaagccgcggctggaaatccccgccggtagcgtcgggattgccggcaagcagaccagcttttacccggtggcttccccggggggctggcgaatcatcggccagaccccgctgaacttgtacgatcctgcccacccgcagagcttttactccgccggcgaccgggtccgcttctttgccgtgaccgaccacgagtttgacctgatcaaaaccgacgtggccaacggtacctaccaagtaaaggcggtgaattaattgagtttacgcgtactaaaaccgggcctgcagactaccgttcaggacctcgggcgccctaaccaccagatcgacggcttccccacctcgggggtaatggaccaacccgccgccatcacggccaacttattggtcggtaaccccgcttccgccgccgtcttggaattcttcatggccggcccgacggtcgagtttacggtcagcacctttatcgcccttggcggggccgactttaaggcaaccttaaacgaccagcccgtcgaccccaaccgctgttaccaggtccacgagggcgaccggctcgctatcggccacgccgctagcggtcggatcggctacctcgccgtgaccggtggcctccaggtcgccccggtgctggggtcgcgttccaccaccctgcgcctgcagttgggcggctactcgggccggcccctgcaagccggcgacgacctgccgattgaagaacacttaaccctgcccggctactaccaccgccacacgaagggcgccgcaccggtttcaaaagacaccaccgctaccatcagcgtgttaaagggtccccagtgggactggtttgacccggccagccgggagtcctttttggacaccacctacaccgttagcaaccaatccgaccggatgggctaccggctcagcggcccgaccctgccggtgccggaccaaagcatgctgtcggcggcgaccgtaatgggggcgatccagatcccggccagcggccaaccgatcgtcctgatggccgaccggcaaaccaccggcggttacccccttttagccgtgattgccagcgccgacttgccgaccttcacccagctggccccggggcaaaccgttcagtttaacttaattgaccaagcagaagcccaaacccgcttggaagaggggcgccgaaccattaaccagctggcccagaaactgcgctcggccgcctttttaccgccctacggaattacccgggtggccaaccagcggatcgccactttatttgaggaggagtaaccatgaacatcgatgaaccaaccctagacgccctaagcaagctcttggataagtaccacctgagcgagctaacctaccaaaccggcgaccagaagatcaccctcaaaaaagaggccccggcaccggtcaccccggtagttagcgcaccggctccccacgccgccccgccagtccgggcgccgcacctcgaagccagtggtaccacgatcgacgccccgaccgtcggcgtcttttacaccgctaagtcaccccaggacccgccctttgtttccgttggcgacaccgtcaaggtcggccaagtcgtcggcgtgatcgaggcgatgaaggcctttaccgacgtggtggccgacgtcgagggaacggtggcggccgtcctagtcaataacgaggagggggttgagtatggccaaccgcttattcaaatcaaataattcccgctcccgctggcccttccacaaggtcttgatcgctaaccggggcgaaatcgccgtccggatcatccggacctgccgggtgctgggcctggccacggtggcggtttattcgacgaccgacgccaaggccctccacgtcaagttagccgatgaggccgtctgcatcgggccggggagcgccgagaagagttatttaaacatcagcgccctgattggggccgccttagtcaccggggccgacgccgtccaccccggctttggcttcctatcggagagcgtcgccttttcccgcgcctgccaggacaacgatctgaccttcatcggaccaagcccggaaacgatcgccctgcttggtgacaaggaggccgcccgcctgacgatgcgccgggccggcttacccctggtcaaggggagccaagagcccctccacgacttagcaaccgccctggcccaggccgaagaggttggctacccagtgatgctcaaggccgccgccgggggtgggggcaaggggatgcggatcatccgcaacgccgaggaaatggaggccaagttcgccgtcgcccaggacgaggcccgggcctcctttaacgacgaccagatgtacttagaacagtacctggcccacccgcgccacattgaagtccaggtgattggtgaccagtacggtaacgccctggccctgggtgaacgggactgcacgatccaggcccgccaccagaaggtgattgaagaggcgccggccgccgtcttaccggccccggttcgcgaagccatgctggcccaaagcgaacaggccgccgcccagctcaagtacgaaggcttagggacgatcgagttcttgtacaacgaggacggttcctattacttcatggaaatgaacacccggatccaggtcgaacaccccattaccgagctgaccaccagggtggacctggtcgaaagccagttcctggtggccgccggggcccagttaaaagcggagcgccccgcctcggttggttacgccatcgagtgccgggtcaacgccctaacaccgggtaagatcaccgccctgcacctaccgggagggccgggcgtccgggtcgacaccgccctttaccagggctacacggtaccgagtaactacgacgggatgatcgccaagctgatcgtctacggtgaacggcggcaacgggccctgcaacagatgcaagcggtgatcgacgaaacggtgatcgacggcatcaagaccaacttagacctcttgattgagatcttacaggcgccggccttccagcgcctgaccaccaccgttaactggttagacgaccaaatgaacccgaaccaaaaggaggagcaagatgacgaggattgatttaaacagcgatctgggtgaaagcttcggccgctacacgattggtaacgacgaccaggtgctggacctgatcacggccgccaacgtcgcctgcggtttccacgccggcgaccccgacgtgatggcccagaccgtcgccctggccgaggccaagggggtcgcgatcggcgcccaccccggcttccctgacctggggggctttggccgccgcaagttagacatggcgcccgccgaggtcaaaaacatggtgacctaccaagtcagcgccttaatgggctttaccaaggaccaccgcctccaccacgttaaaccccacggcgccctgtacaacgccgccgctaaggacttagccctggcccgggccatctgcgagggggtcgcccaagttgacgaccaactacccctctatggcctggccggcagccaactcctggtggccgccaaggaagtcggcctccccgcttattcggaggtctttgccgaccggggctaccaggcagatggttccctagtgccccgtagccaacccaaagccgtcttgaccgacccgctggccgtggccgagcgggccctttcgatggtccaaacccagtcggtaaccgccgtgactggggaaacggtgccgctcaaagtcgacaccatctgcgtacacggtgacaaccaggccgccttagccctggtggaccagctacgccaaacctttaccgccaacggaattaccattcaagcatgttaggaggaactgccgatgcaagaaacgactgatcaccgccgtaccgttcgcaacgccgcgattgggggcgcctttttaatggccatgtcggccgtggggcccggctttttaacccaaaccgctacctttacccaacgggaaggggctaacttcggtttcgccatcctgatgtgtatcatcgtcgacgtcatcgtccaactcaacatctggcgcgtcatcatcgtctccggaaagcgggcccaaatgatcgctaacgacgtcttccccggcctgggctacttcttatccctgctcgtggcgatcggggggctctttttcaacatcggaaacgtcgccggggccggcctggggctcaacgtcttgtttgggatcccgaccatttggggcgccgtaatttcggccgtcgccgccgtcttgatcttagtgatgaaaaacgccctgaaggccgtcgaccggaccgtccaggtgctggcggtcatcgccgtcttggtcctcttgtacacgctggcgatcatgaagatcccgtacgggacggccgttagccacacctttatgccgaccaaggttaacttctactcgatcctgacgattgtcggcgggaccgtcggggggtacatctcctttgccggggggcaccggctcttagaagggggcgcccaggggaccaaagacctcggtgccgtcaacctcggcgccctgtccggaattgggttagcctccgtgatccggatcgtcctcttcttgaccgggttagccgtggtcttaggtggtgccaccctagacgccgccaaccccgccgccacgatctttaaggtcgcggccggtacctttggctacaagttctttggcctcttactctttgcggccgggatgtcctcggtgatcggttcaacctttacctcgatctcgttcttggactacaccagccgtaaaaacgaaaacaccgaccacaaccgccactacaagatggcgatcacgatcggcttcattgcctttgcgacgttgatcttctgctttgtcggccaaccggctaccgtcctggtggtcgttggggcgatcaacggtttcatcttaccaatcgccttagggatcctgctggtggcctcccacaagaccaagatcatgggggcaggctaccaccaccccgcttggttgacttggaccggctggctggtcgttatcttcatggcttacgcagggattaacacggtattaaacctattgtaagaagtgcgactcaaccgtaaagcaggccgtgggctaagtaaatactaaccaatcaaaaagggctgcgccgagttggcgtagccctttattgttagtattgtgcgctctggtagcgccggcgtaagaataaggcggccaggaccgccaacaccccgtagaccgccccgacgttaccgacgtgggtcaggcctaagaagcccaccgtttcggccgccgtaaaggagcccagggaaatcccgatgttagcaaagatcgagtttaaagacgaagccagctccaaagactgcgggtagtccctttcggcgatgtctaaaaacatcagctgggtggacgccccgtaacaagcgatagccacgcaaatcagggcgatggccaaaacgtccaaccacggaaagtggaagagcggcgccatcatcaataacaagcaagtcatcataaagtagatgtggggcagttgcttgatcccgcccatgtcggctaggtaaccgccaaacttgttgccgatgataaaggcgacccccatccccagcaagatccagttcagggtactgatcgaaaagcccatcatcgttgacaacagtggccggatgtaggtgtaaaaggtgtattggccggcgcagacgctcacgaccaacccgacccctaacaggatccgggcgtccttcaaaaggctaaactgggccaagagactccccttggtggcggtgtcttcgcgtggcaccaaaagcgccaagccgatcaaaaccagggtggcgatcccggtcaccatccaaaaggaatcgtgccaagaaaaggtggtactgatcatcgtgccgatcggaatcccgatgatcgaggcgatcgaaaagccagcaaagacccaggaaactagcccggcccgcttctcgcgcggggccagttgggccgctaagattaaaactagggagatgatcgccccggacacgctcgccgtcaaaatccgcgacaagagcagtgaccaaaaacccccggccagcgccgtccaggtgttaccgaccaagaagatggccatgtaaaccaataagatgtcatagcggcgaaaacggctcgctatggtggtcaagaccggcgtcaacagggcgtacaccccggcaaaaacggtcaccaaataacctaaggtggccagtggggtgccaaattcacccttaatgtctggcaagacccccacgatcatgtactcgttgcagcctagcataaaggccaccatcacaaataaaacggcctgcagccggtacttggtcatcaataactcctcccatctttttaaaacaatcaacgaccattgtacgtggtttagggcccggattccagccctaatttcttttgatttaaggttttaacgcaaccgctatcatgctataataattaaaagatcaatcgactctgttaaacacctccgctccttgcgggggtgtttactttttttaaccggtcaccaaacgacacacgacaaatatttagatttgcgcaagataacgtactccccaaccgcagacatagtggctaagtacggtcaaataacaccgcgttccgcgctaacctttaccctagcttagccatacggcctgcttgataggttggggcacactcctttttattacgcaaatttgcagatttgtcctgtccccaaaaaggagcctgggagaaaatcggattttctctcaggctctccctattttacctaacggttggtcgcacttacgataacgtgctcccaaccacaggtctagtggctaagtacggacggagaacgatgcgtaccgcatcgccccccatcctagcttagccatacgacctgtcgagtaggttggtccgcacttccttatttcagcaacgccgccaccttatccccggtcgttgggtaggcctcgatcatggccgcttgccactgggcccgtgacagccccaagccaatcgcgggcaggacggcgttgacgtcatcggccgcccccgcccccagggcactgatcccgaccaggcggtcctggttgtcgtaaacgcagatgtagtgcgggtgctcgttttgcccggcgtaaaggctactaccgccccaatcaaattcttcaacgtgctggccagccgttgcttcatcggggttgaccccggcctgggctagggtcgggtaagaaaagacggcgctggccaccaccggtaggttgaagggcgccgttgggtcatcgtggccaaagcgggttagcaggtagtcggcttggcgctcagcaaccggggttagcttgggccacggccggttaaccacgtcgcccaccgcgtagacaccggcaaagctggtctggaggttttcgtcgaccgcgatcccgtggcggtcgtattcgatcccagccgccgccaggttcagcgcttcgacgttggggatccgtccggtggcgtcgatgacatagtcggtcgtcagggcgttgccattgttagtaattaaagtaaggcgcccatctgcttgcttgagttcagcggggctggtgttaaagacaaagcggatcccccgccccgtcatttccttgactagccgccgcacgttttcccgggcgaagtttttcaagacccggtcgccccggatcagcagggtcacctgacttccagccgccgctaatagggtggctagctccatggccacgtaaccgccaccgatgatcgtcgtggtggccggcaactggtccagggacaagacgtcggtggaatcgtgggttagctcgctgcccgggaaatccagccggtgcggacgggccccggtggcgatcacaatctggtcgccggcgaattcctcgtcccccacggcaaccgtgtgcggcccggtaaaccggccggcgcccaccttaacggtcacccccggcaactgttcgtagatcgccttggtttcgctgggccaagagtcaaagcgggccttcttggtcttcatcaaggtagcccaatcgacggtggccgcctgatcaatccccttacccactagattggtggtggccaaggcggcgcgaacggccccctccaaaaagatcttgggctcgcaccccacattggggcaggtcccgccaaacaagttgggttcgaccgccagaattcggtggttatcgccagccaagcccttagctagcttgtagccggccggaccagttccgagcaaaatgtagtcataaagttccatttaagccacccccattaaattcttgatcgcgcctttattataaacctaaagaggggagcgtggtgtctggccacactccccttttacaacgtactcccaactgcaggtctagcttagccatacggcctgcttttcggttggtcgcactcctttttacaagtacttcttcagcgtgtcttcaatctggtccttggtgtgcaaaccgatcagcttgtcgacaacttggccgtcctttttgatcagcagggtcgggatgctcatcacgccaaaggcggccgccgtttgtgggttagcgtcgacgtcgagcttgttgacggtcacttggccggccatgtcatcggcgacggtttccacgattggggattgcatccggcacgggccacaccaggttgcccagaagtcggttaaaacgaccccggagttcgtgtcttgttcaaaagttgcgtcagtggtttctgctactgccatgttaaaggcctccttgataaattcttaagctaagtttaccagaatttcaaagcggtaccaaatattatgacttactatttgttagtttattttaaccgtcggcacccctataatagtaacattaatgctacgaaaggtgttttcccatgtgcttatcccaactcgccagccaaattgccgtgatttttttgttgatgctactgggggccctcgcccgccagctgggttttctaagcccgaccacgatcaacgacctcactaatttggtcctctactttttaagcccgctcgtgatcatcaaggccttcttggcgcccttttccgtcacccggctgaagatcttttgcctgaccctggtcggggtggtgatcacctacctggtcacgatcctactggccaaactggcctttgctaaggttaaagacgctaacctgcggcggatcgccacgtacgggtcgatctattcaaacaacggcttcatgggaatcccgctggcccaggccctctttggcagcaccggggtcttttacggggtcgtttcgatggtcggtttcaacgccttcacttggacccacggggtggcaatgtttaaaaaacagtccgccgccccgctaacccggctcaagcgggtcctggccaaccccaacttaattgccatcgccttggggattgtgatcttcaccgttcaaattccggtccccagcatgctgacgtcctttcttgactacgccagcgccgccttcaccccgctatcgatgatcatcatcggctccaacttagccggtatgcgccgtgccgacctgaaagtcccaccagttttaggggcgacgatcttgttgcgtaacctggtcttcccggccctgacgatcgtgatcttaaagtgcctcggcttgaccggggtgccgctgatgaccaccgtcatcttagccgcctgcccggtcgccgggttagtggttctcttcaccctgcaagctaagggcgatgcccgcccggccacggtcgtgatgagcgtttcaaccctcctgagtttggtcaccatcccgctggtcttttccttgctcgacctcttgtaggggcgctgccggttcatccaccggcggttggtgcttcagccgttccagttccacctttagttccagtatcttgcgttcttctttgacccgcttggtccgttccttggtgacccgggtgaccgtttcgttcaccagcttgtagaccatcaccgacacaatcaagacgatggccacgatataagtatccatagcgattcctcctcttaaatgctattgtatcttcgtcggttacactaataacatgctcaccaaccgcaggcctagtggctaagtctggccacagaacaccgcgtaccgcgctaacccgtgccctatccttaccccacggcctgcctatggttggtccgcacttccaacattatacgtgaactactcggccataaatgaccgagcttctgggaacacgaagtagtatttaggatgttgcttctgtattcagaatacctaacttacagaactccgttcttttaccacggctagtccctagccaacggcttttaatcctctatggagtatattaactgccgcattaatatctcgatcgtgatgagtaccacatttaggacaagtccattctctaatttcaagtggtttcttcccactatggtaaccacacgtgctacagatctgactggtgtaattaggattaatagtaattaactgtttaccgtaccaatcacacttgtattccagcatagttctaaatttgtaccaactggcattcgcaatagctttagctaaatggtgattcttttgtagattcttggctttcaaatcttcaatgacaatcacatcgtattttttaactaaggctgttgttagtttgtgtaagtaatcttgacgttggttcgctatccgttgttggtagcgagccttttgtttttgagcccgttgccaattctgataatcattgagatccatttttacgtctttatgattatggttccattggcgaacagctacggttgcttgatattttcggcgactatacttgctttgccactttgtggcttgcttttccaaccacttagcattaaaagtaccaaacttttcaccgtcagaactaatcactaaatcagcgatcccaacatccaggccaacggtcttgcctgtttttggcaatgcttctggagcaacagtctcgacctgcaaagataagtagtagcgaccagttggaccatagctgacggtataacgcttaattttgccatttacagcttgagaggtcttactagttcgaatgcttcctaacttaggtagcttcattcttctcttggcaatcactgtgcagaccgaccgaccagtatatgactgtttggcggcgtgcctgcttttaaagcgtggatagccaccacgatgtttaaacagcatcttaaaagcttggactagattatggttcaccacaaggaaactagtcgcatcactgtctttgagatagggatattcttgtttcaactgtttaagcaagtaattcattccatattcatttacaaaatgactactaggattgttttgatagcgttgcttagccatatctagcatgagattccacactctacggtcattgccgaacatttgccatagttgagcttgttgttgcttgttagggtacaagcgtagcttgacccctttaattaatttggtcattctaatttcacctcctttttgcgttgatcatcaatatacttggctactgcttgttcattaacgctcccaatgctttcaacataataacttggtgaccataggtgacgaccttgctttttccagtagctagtttgtagttctggacattctcggaagaggtgccatgcagaaatgcctttaagccagcgcatgatgttagttacagacagttttggcggagcgctcactagtaagtggatatggtcatctttaccaatctccatatgagcaatcgtaaatccatattttgaagctatatcatataatgattgcttcaagacttcttctacgtgtcctttcaacactttattacgatatttagttccccaaattaaatgataattaagattgtagactgacgttctaccatatgtaattctttttgtatctttcataccaataattatattacattacggttcgatcatgtgccctaagagcacaaaaaaaggcaattcatcacgtccttaaaagaacgtgtttccttgcccgctttcaaaaagaaaagagactgggaaaacagggctttcctagtctcttactgtatgtctgaatgttagacagataacgtggaaaataaccgcaggtctagtgttctaagtacgggcgaagaacggtgcgtttcgcaccaaccgttcgccctagcttagtcatacgacctgctttagaggttatttcccactccctaattattcccaacccagctcttctgcgttggaggggaggcttagtttgccagcggccagttcggcaaaggcctggtcgatgatggcaaaggctttgtctaattgttcttcggtgataaccagcggcggttggaaacggaggatgttcccgcgcaggctaatgataatcgccccgagttcaaagatccggtacatcagcttggtggtggcttcaacgtcgcccttaccagtggccgggtcgacgatgctaatcccaccgttgagcccgtacaagcgggcgtcgccaacgaagtcgtacttggcttgttcctggtcaaagaagtccttggccttttgccctagcttcgccgagcgttccaccaggtgttcttcttcgatcacgtcgagggtggcgttggcggcggcggccgtcaccgggttaccggcggtcgtgtagacattggccgccgggccgagcgcttccatgatctcttttctgccgaccacggcgctcagtggcatccccgaggccagcgacttaccgaccgacatcaggtccggttcgatgcccgggaagtgttgaattgaccaccactttccggtccgccccatcccctggttgacctcgtcaatggcaaagaggatcccgttttgcttggcaaagtcatagatcctttccatgtaggcctggggaaccttgatgatcccgccgtccccctggattggttcaatcacgatcgccgcgacttcttcggccggcaggtaggtttcaaagggttgcaaaaaggccttgtacatccggtcgacaaactggtcgtcgctttcaccggctaacttgtcccacgggctcgggaagggcaccttcaccacgccgggcaagagcgggcccatcttacggctcatgtttaaggtgatgcttgagatcgtcatcgagccgtacgtggagccgtgataggccccggtgaaggaaacgatgtattggcgcccggtggcggcgcgggcaaacttaatgatcgcgtcgttggcgtcggaccccgagttaccccaggcgacctctaccggcccgctgatcggtgccaacgccgccaggcgcggggctaagcgggcggcctgggagttcgcaaagtaagcgggggtgtattggatcagcctggccgcttggtcagcgatggccttgacgaccttggggtgggcgtggccggtattggtagagctagcactggccaagaggtcaatgtagtcgtggccttccacgtcggtaataatggcgccccgccctttatcaatcacaatgtcataatacttaattcgggccgccgaggaaaaggcctcttcttcggcagcgagcatctgctggttactttttttctcctccatgatcagtgtctcccttcttggccaggaatgagtgactcatcccgtatgcgaagtaaatgactaatcctaaaacaaaccatgccccagcgtagagctttgcttgaatgtctaagcccatgaacacgaagagggcagcgatgaaacctaaggccggcatgaccgggtaaaacggcatcttgaaggcggggttcggaatatccttcccttcccgcggccgcaaggcgtaaatccccagggaaacgaacatgaaggcaattaaggttccggcagaaatcagttgggataagaaggcgaacgggaagacggccccgattacgatggcgatgatcgtcaaggtccacagggcgcggtttggccgttggtgcttgtccaattgaccaagccatttcggcaacattccgtcacgcccgaaggagtagatcagccgggagccggccatgctcatcccgatcagggcggtgaacatcccaactacggcgatcgtttgaacaacggtggcgaccccaccgtgaccggcggcccgcagtgctaacccaactggttcggcggagttggcgtacttttggtacggcagcatcccgatcaggaccaaactaacggccacgaacagaaccacggcgatcgccaaggaccctaagatcccgcgcggcatcgtcttttgcgggttaacggcttcggcagagttggcggcgatcgagtcaaacccgatgtaggataagaagatcatcgaaaccccggcgtaaatcccttgccagcccccgaacggcccgttagccgtttcgtggtacttggggatgaaggggtggaagttagcggccttgatggcaaagaggccgacgacgatgaacaagagaatcgcgaagacctttaaaaccaccaggacgttttcgacccgagcggcttgcgaagcccccatcgcaatcaggacggcggccacggcaatcacgaccacggagatgatgtcgacgaccccaccgtcagtcccaaaggcgttggataaggagttcggcagggtgatccccattggcgccaaaagcccccgcagattggccgacagccccgacccaacgaaggccagggcgatgaagtactcggctaacagggcccagccggcaatccatccgaaaaattccccgaagacaacgttaatccatgaataagcggacccggcgaatggcatcgccgccgccatttcagcgtaggcaaaggccaccaggccggccacgacggcagcgaccacaaaggagatcgccactgatggaccggtgtgaatggcagccacttccccaggaagagtaaagatggaggtcgacacgatcgtccctacccccaaggctaagaagtcgcgcacccgtaatgatcggaccaggtgggcgtccttattagcgtatacgtgcggatcttccttccgcgtaatggttttccaaaaactcactggtttttcctcccgttgacaattagatcttaattagaataataagaaaagtttaactcattctatcaatctcaccgggattagtcaatgttttgccgccgctaaattagagttttattagaatcaactagataatattatttcattaattaactaaccgccgttatttaaatcttctttgccgaggtggcgctttcattaccgtttccataattggtttagtccaaaaaaagagtgggcccccactctagccccgtcgctaacaacggtcggccagtggtgggtacccactcctcaacgtagctttacttaaattggtgtcccagctcagccgcttcctggacgtgcttggccagctgacgcccgttccaggaatcactagccaggaccgtgccggccggttgccagcgcatgtagtccagcagctacttgaagtacagcttcatggaggcaaaggcgctgtcatcgccgtacccggaaatcagggtgacggcctgcttgccgccgtgcaactcgtggttgtaggcgtaaaagcggtcgatgacggccttcaaggcggcgttaatcccgtagtagtacagggaggttaccaaaacgaccaggtcggcctcgatcagcttgggcaggacctcgttttccaccacgtcatctgggcggacggcgacttccatccccgggcactcgtcctccagctgcaggagactgaactcactggcccggcgcccggcgtcaaagctaaacttggtggccgttttcccggaccgccttttcaaaggcatcggccagctgttcggacgttcccgggtggtgcgggctcccagttaaaatgacaattttcatggtgtttccccctttagtagtattacttacattatataaggggtagccgcaaatgggaaatgcttaacctgaggcgaagttgattcattttacctggctggcctcttgtagggcctggtaaaagtccggcaggtcgcggttgagccgcaagagcttgccgtcctggttggtaaagcagtgctccgaagtcccctcgcacaccagctgatcgtgacactccattcggtaggacagggtcaagcgcacccggtcgagggcggcaatcttggtggtgattaccacctggtcactaaaggtggtcgagcgcttgtagcggcagttgaccgaaacgaccggtgagatgatcccggctgcttcaatcttggcgtaatcccagccgatcgccgctaggaagtgggtccgggcctcctccatccagcggacgtagttggagtggtgggtgatccccatccggtcggtctcgtagtactgaacagtgtgggtgtagaccgtcccggcggccgggaagaccaccttggtcaggtccacaccttggagcttggcgatgaccggcttggcggcccccagccagttgaggtccgctaattcttgcggggtcccccaccggaaggcatcgtgagcgaccgcggtcagggcgttgccttttaaaccagcgtaaaagacctgcatgtggacctcgccccaatcgtaggtgtgaacgacggttggtaaaacccgttcaccgatataggatgcggtccccagctcctcttttaattcgcgcatcagggcctggcggggatcttcaccgggtttgagcttgccccccggcaactcccaaaagccttcgcccaagcggcccccttcccggcgccccgccagcagcttggccccgtcaatgaccaccgccgctaccacgttaatctgttttgccattcgaatccctctctccgccggctatttcccgggaaattatttccgtcaccggcccttttcttctataataagcgcaaacgaaacggaggtcacgacaatggtagagaaacttgatctaaacacgccagaatacgcccagctggaggaacggatccagtaaaatcagctgctggtccaagaacttaacacccaggtccacgatgccgccgcggtgcgcgaactggtcagccagatcaccgggcgcccggttgacgagagcaccgaaatccgcttgcccttttacaccgactgcggggtccggattcacctgggcaaacgggtcttcattaactcaaactgtatgttcaccgacctggggacaattaccctagaagacgacgccctgatcggacctaacgtgaccctggcgacggtcaaccaccggcgcaacccggctgaacgccgtcacttagacctcgccccgatcgtgatcaagcggcgggcttgggtcggtgctaacgccaccattacccccggggtcacgattggcgaaaacgcaattgtggcggccggggcggtggtcactaaggacgtggccgccaacacgatcgtcgggggaattccgacaagggtgattgggagaatttgagtgcgacccaacctcctcgacgggccgttgggctactcatccgaaaactaaaagcagtggaccatggccgtctcgggtcatggtccactgcttttttcaattaatcatttagaaagtagttgcttggcggcttcaatctgggctttgacctggtcaaacccggtcccgcccagcgagttccgccgctcgacggccaccttagattggaggtcgtggtaaacgtcttcgccgatcgccgggtcgatctcttggtacttggccagcgggatttcctgcagggtcgtgccggtcttgagcccctctaagaccagttgaccaacgatggcgtgggcctgacggaagggaatccccttggtggccaggtaatcggccagctcggtggcgttggagaagtcgcgctccgtggcctgcgccatcttctccttgttgacgtgggcggtttcaagcatcccggccaccaccttcaggctcggcatgatcgtcttaacggcatcaaagagcccttccttgtcctcttgcaagtccttgttgtaggccagcggcaggcccttgatggtggtcaagagccccaaaaggtggccgttgacccggccggtcttgccccggaccagttcggccatgtccgggttcttcttttgcggcatgatcgagctaccggttgagtactggtcggacagctctaggtagccaaattcataggaacaccacatgatgatctcttcgcacagccgggacaggtgggtcatcaaaatggcggtgttggccaggaattcgaggacaaaatcccggtcggacacggcgtctaaggaattggcgtagggcgcctgaaagtccaagagcttggcggtcagttcccggtcgatcgggaaggtcgtcccggccagggcggccgcccccaacggcattagatcggtgtgctgttggttaaactcaaaccgttcgacgtcacgctgaagcatctggaagtaggccatcaggtagtggccgtaagagatcggttgggcgtgttgcaagtgggtgtagccgggcatgatcgtttcgacgttggccgccgccttttcgaccaataccttttgcaagtccttgatcgcctggatgacgtggggcaggcggtgcttgacgtagaggtgtaggtcggtggccacctggtcgtttctgctccgggcggtgtggagcttgccggccaccggtccgatctcatcggtcaagagggcctctaagttcatgtggatgtcttcattttcaaccgtaaacgtaagctcccctgcttcgagttggtcctggagcttcttgagccccgtaatgatctggtcagcgtcggccgccggcaggatcttggtttcctttaacatcgtcacgtgggccaaggaaccctctaaatcttctgtggccatctgctggtcaaaggagatcgaggccccaaattcttcgacccacttggcaccggtcgcttcaaagcgacccccccacattctcttaactgccattaattcgttaccccttggtgttgtacttgatagataaagtccggcgccccttcgtccttcgttggtgccgcgggcttcttttgggctggcgcttggtcttgttggtggacctgggcgtaaacctgggttggcaagccgtacagcttgatgaagccagcggcggcttcggaatcaaaggagtcggccaccgtgtaggtcgccaggttttcgtcgtacagcgagtttggtgacttccgcccttcgcaaatgacgttacccttaaagagcttgacccgcaccgtcccgttgacgtcctgttggctttcctttaagaaggccagcagggcagtcatcaacggcgtaaaccactgggcgttgtaaaccatgtcggcaatttgcttttcgatcaccggcttgaagtgggccagcgaccgttccagggtgatgtcttcgatatccttgtgggcggccaggaggaccgtggctgctgggcattcgtagatttcccgtgacttgatcccgatcagccggttttcgacgtggtcgatccgaccgatcccgtgcttaccggccagcttgtccagggtcatgatcaaagtggccaggctcagttgctcgccgtttaattcgcttggcaccccgtgttcaaaggtcagttcaatgacgtcgggggtgtccggggtgtcttctaaggccaccgtccggtcgtaggcgtcggccggggcgctcgcccacgggtcttccaggatcccgcattcgttggcccggccccagaggttttcatcaatggagtacgggctttgcttgttaatcggcactggaatcccgttttccttggcgtagtcgatttcttcttcccgcgcccagtgaacttcccggatcgggtcttcgatcttcatgtccggcgccagggcgtggatgccgacttcaaaccgcacctggtcgttccccttcccggtacaaccgtgggcaatcgcggtggcgccgttttccttggccacctccactaacttcttgacgatcaacggccgcgaaagcgctgaaacgagggggtacttattttcgtacatggcatgggcctgcaaggcgggcaggcagtactcgctggcgaattcttccttggcgtcgatgacgaccgacttaacggcgccgaccttaagccccttttccttgatggcctccaggtccttgccttcaccaacgtcaatgcagcaggcaatcacgtcgtaccccttgtttttcaaccaggcgatttccaccgacgtatcgagtccccctgagtatgctaaaacaactttttccttggccataagctcgtcctcgctttctattttcaatgattaattgtgactaaggatacactccttttgcatgaaaatcaaataaaaatgcaagattttcggaaaataaccgtcagataagcacaaataacggattatatgcattttattttgaatattcacccccaggagttcgctaccaaaataaaacgaccgtcccgcccgggcgatcgtttttttaatccgtactaaataagtagcgcaggctccggcccccggtggcgtggtggttaaccaccagcgggtgcggggctaggtggccgtggggccagctagttacccaaactggctgggcgcgggccgttgggttcgccaccacgagccggtaggtgccggcggctaacttcccgcggtaggccaccaccccaccgcggcggtggagggccagccgctgaccggcgggcgtcagcagggtcacggtcgcccggctcttatgcggcagccaaacctgggcccggctggcggcgtggtgaagcgtcaccgcctggctcagctgggctccaggggcgagttggtaaggccgttcgccgtactggaccgatagcgagctttgctgggtggcgacggtaatcgaattaggcttgggaaggctggttaacaggagcagcgccccgacgagaccgaccagcggccaccagaaccagggcagtcgtgccccaacgtcattgaagcggggcgccgtcggcaggctgacgagcccgaataagaacgggagcagggccaagccataccggtcctccacttcccacaagaggacctcgaaggccacgaagccgaccgcccagaccgccaagaggaccgcggtcgccgagtttaaacgcaggtaaatgaccttacgcaaagtcagggcgaagagggttaaccagccgacctgtaataggaagttttgtaagacaccggccagcttggcgtgggccaggtaccaagccggtgcccgctggggtccggcccggtactcgattggcacgtggcgctcatcagtcaagttaaccagcttggtcccccactgctggaagaggccgccgaccccgagtttcttaacctggttcactagggcgctttgaacgaaccgctggcgggtggccaaattgggcaaggtttcctcttgttgcaccacctggctgttgtactggcccccggtggccggcaggtaggacatgtagatccaagaggtcgccggcaggcggtagcggtcgtttgcttggtagtggcccgccgtcaggagcgcttgtttaaccggcaacgttagggccaaggcaaccaaaaccgtagtaaccggggccaggagctggcggcggggtttgaccaagcaccaggttaacaaaacggccggcgccaagacgatcaggttgggcttgatcaactggccgaccaggaccgccccgccgaggacgagtaacttcgcccagtggggccgttcttggtgggcctgccaaaccagcaggatcaccgccacagccaggatgctgggcaggtcgctgtaaggaacctgcaagaagttggtgtaggtgaccgagttgagcaaaaaccaggcgacgactaagatggcggcggccctgtctttggcgagtcggctggctaggtgggcacaggcgaggatcagggcgttggtcattacaaaacccagcgccccgagcgtagtggcgtcgtcaaacccgactaagtgccccacccagagcgggccggccaagagaacggcgttgacggcgttattggggtagcggtaaaagtagtcgctggccccccagtcgaagtggccgctagctaacaggctggcctggtagcgcacccggaaggggtcatgaaagacgctggtcggcatggtcagtagcacggtcagttcgatcaccgccgtcaggccgagcaggccccaacacaggttccgtttggtggtggccgaccgaccgcttaaccaacgccaaacccggggggcgagggcaaggtcggccaaaatgattaacagggcgccgcgcccttgtttaaggtcggtcccgaggttggcaatggtggccattaagaggattaacaccagcaccgccctgacgagcttagtcatacacgcaccccacgatatctttgagcgggtggtcgcgcaggaccgtcagcatccccaccaagtcggcgctcgactccaccatcccgtcgttgatccacagcatgatcacggcgcttacctcgctggcaaacacggcccgcccgtacttggccggcagtaaggtggcccgttcaaaatcggcttgcaaaaagtcctccatgatcgagattaactcccgcttgagaattgtttcgatccggttggccaggccgccgtgcaccatcgccatcaccagttgccggttttgcttaacgtaatcgatcaccgcacggatgctgtccggcgacagagcgtggtgggcgggatcggaccgcaggatttggcgaatttggccaaacaattggccctccagccatgtttccaggtcgtaaatgtcagtataattgttataaaaggtgccccggttaatctgggcacggtcacacagttccttaaccgtgatctggttgaagccgcgctcctctagcagggcgatgaaggcttggtagaggcgggccttagttttggtttgtcgggtggcggtcatctttttctccttatttcaacacattgttcaatttgttgcttgttcactttttttaagaatactacaataaggttgttaaataaacacatgtcgaattaaaagagtgaggtttagaaaatggcatacatataagtgataaacaacaccaagaccttcccgtccggtgacgagccgaccggggcgctggactttgaaaccggccgcgccgttatgcaaatcctccaggacatgagcagaaagcagggatcgaccgtcttaatcgtcacccacaacgccaccctggctccgatcgccgaccaggtcatccacatccacgacggccgggtgaaggagatcacccaccaggaccacccgcaagacatcgccactttggaatggtaggtgaagatcgtgagcaagaaaatattatataaggacgcctggcaatcgatcgggcggtcgccgggccgtttcatcgccctggtcttgttaatgttgctcgggaccttctcctttgtcggcctcaaaatcaccgggccggacatgcgccagaccgggctgaactactttaaccaaacccacctggccgacatgaccgtcacctccgcctacgggttaaaccaggccgaccaaaagacgatcgccgaccaagcccgggtcaagaccgtcaactacggctacttcaccgacgctaagattaagggcatcaccaacggcatccgggtcttttccaattccggttccctgtcgcagtataaagtggtggccgggcgcctggccaagacagacaccgaaatcgccttaaataacaccctcaagggcacctaccacctgggcgaaacgatcaccctgcaagatggcaccggccttgctaaaaccaagtttaaggtcgtcggtttcgtcgagtcggccgagttcatcaaccacaacgactttggccaaaccagcgttgggaccggccagttgagcggctttggggtcaccaccaaacgagccttctccctgaccgagtacaacctcgcccggatcagctaccgggataccgccaagctcaacgcctattccaacgcctacacgaaactgatgaataagcggcaagcgacccttttaaaggacctcaatcagcaccgggccgccaagtaccaggcggctaaggctagcctgtccaccgccttgattaaccaggacaccaacgccctcgatgccgccagcgtcgacgccaccctcaccctggttgaagacttcttgaccagccacggcctcaccgccgttcgtgaacagtccaccaccgctaatcccgtcctggtcaccgacctaaacgaaacggcgccgagcgccccactgatcttattgggccacttggacaccgtcttcccggtcgggaccgccaagcagcgccccggcgtcattgacggcgaacgcctcaccggccccggtagcaacgacatgaagcccggcgccgtgatggccatcgccaccctcctcgcgctcaaggaggctaactaccaggcccacccggtccgcctgatcttggttaccgacgaggaaatcctccacaaaaacgccccgacaaaggaaacaatcgcccgtttaagtaagggcgcggtggccggctttaacttcgagtccgccgaccccgataacggcgtcgtcaccggccgcaaggggggcgccatcgttgacctgaccgtgaccgggatcgccgcccactccggcaaggaaccagagaaggggcgctccgccgttttagaactggcccaccaaatcattaaggccgaagccctgatcgaccaagccgccggcaagctcgtcaactgcggtttagtcagcggcggcaccagcgaaaacatcatccccgaccacgcccacaccggaatcgccgtccgcttcaccaccaaacaacagggcgacgagttacttgcggccctgcaagaacaggccgcccaccccaccgtcaccgggactacggtggagatgaaggtcgccaccaagatcgacagcatggacaccctgccggggaccgcggccctcttagaaaagctccaagccagcgcccggctcctccaccaaccggttccccacggcaagcagaccggcggcgcctcggacgccggggtcctaaccgctcacaacatcccgaccctctgcggcctggggatcatgggcggcggcgcccacaccgcccacaagtacggcctggtgtcgtccatgtttgaccgggccgccctggttgccaccaccatcgcgcacctcgattgaggttataattaactcaattaattaaagggggaacgccgtgatgctaatgggctcagaagaagcgtgccaggcactgctaaaacaattatatgacctgaacatctcctaccaaatggttgaccacccggccgccgatacgaccgaagaggccgatgcctacatctccggcaagggtggggtcgccaccaagaccatgtttttaaaggacaagcacaagcgcttctacgtgttagtaatggacgacaacaagtgcctcgactttaaggagttccaggagctgaccggcgccaagcgggtctcgatggccaaagacgccgacaccacggcccagctcggtctggtccccgggatcatctccccctttggcctggctaagcacccccaagacgtggttggggtctactttgaccaggacatgttagacgaacaaattccgctcaccttccaccccaacgtcaacacccacacgatctttttgagcgccgcagacctccagaaatttatcgaagcctagggctaccaggtccatgccttagctctttaacgccaaaaaagcccggtcacgcaacatgcgtgactgggctttttgtgttggtgaggatatttcaatgatatcgtggaaaatgaccacagacctagtagctaagtctggacgaagaacggtgcgttccgcgataacctttgccctagcttagcccgacggcctgtcaagaaggttgggtcgcacttcccattaacgtgctcccaactgcagacctagtgcctaagtacgagcgaagaacaccgcgttccgcgataacctccgctctagcttagtcatacggtctgctacttcgttgggtcgcacttccttactaccacgaaaactcctcatagtagatctggccgctattcaagcctaactgggagaagagcttgacccagtggcgtcccatcggcgccggccccccaatcaggaccaccagcttgctgaggtcgcgcggcacggtgttgagaatcgtttcgtcatcgaagcggccgacctgcaggtaatcagtgaagttatcccgttgttcccaccgggcgaacttttccgggtacaggaggttgttttgggcgtgggcgttgtagaagaaggtcgtgtcgatgtccgggttggcgtcaacgattgaaagcatgggcaccaccccgatcccaccggcgatgatgatcatatgggtcggtttgacattgtcaatcgtggtttggtacaggccgtaccccccgttgaccagtgcttcggcccccggttccaccgtggccaggttcttggtgaagtcaccgtcgccgcggatggcgaggaccatttccctattttggttgggcgcactcaccaccgagaacgggtggggttctttcatcttggcgatcttggggaaggagaggaaaacgaagtcgccggccttggtgtcaatcggcttagtcagctgcaagcttaattcttgcacccgggggctaatctccacgttgttggccaggatcgcccccacgccccggtcagggcgcaggctgattaaataagccactaagacgaaggcactgtacaagtagaaggtaaacatgaacggcgcgatcgcccggatgtaagagatcaacatcacgtggatgaagaccaagacggtcgccactaagttcagtttgtggatccacaccgaaacctcgtgcttaaagatctttttgctgagctgctttttgagcatcgccaacggcttgacccggctggttagccacccggccatgaagaccaaagagtagatcgccagcccgacgaagaggtcaaaggcccagtcaccggttagtttgatcaaacctccggacggcgagccaatcttgtgcaggtaggccaagacaatcgccgcgatgctcaagattccgtggagcatgtaggcgctgggcaggccaatcaagcggtcgagccacttgggtttggtgccaatgtagatggctaatagcatccaagagtaggcaatcgaaccaaagatgatcgccattttttcgctgctgtagatggcgggcaggcccgcgcttaaggtctggataaaggggagcgggatgacgaagatcgccaccacccaggccaggccgagtaggtatttacgccgcgttaacattattaatcgccccccgattaaagaccaccagttgaccggtttgggtgaggtagagcccactcaatcggtacttggcaatcagcgcatcgaactccgcttgtcccgctgccatcccggccgttgcccacacgtcagcaaaacttagttgatcgtcgaccaccgttacttgcaggaggtcatcttcttttactgcttgaatgtggtggccccgcttggagtaacctgacgtcgccaccgccccgttagtgagttggtaagcggccaggtaactttgcaggtcgcgcgggtcttcaatcccaatgttccaggtaaagtcgtgttggctggcaaactgcatatcgccgcccccgtttaagcagaccccgacgacgcgcgagtcctctaagagcggtgccaggtgcttttcaaaggcggtctggatgctccagcccttgacgtaaccagtcgggtcgtacttaccgccgtaataagggttaaagagcccctccgtttggtccttggcgactgacacggcgccatacacctgctgaaactcacggtcgagggcgagtaaactgtcttcgccccgttggaagcggctcaccaaggagtcgtctttaaagggggaaaaacgggcgtcgacccttttcaaatcagcttcaatcagtggcgtgacgctgcccaggtattcgtaggctaacccttcgtcggtggcggccacgctgatcgtaaaggggaccgttattgcttccacgacgtttgctttaatgatggttttcatgatttattcctccgcttgattaatggcgctttgcagagaaccagtgaagcccttgtaagtttcggtcgccccggaaacttggttgatgttggcgctttgggcggccagggcttcttgcttgtaggtcggtaaggaacgggagttgatttcgtcagacttcccgccagtcgggtactttaagaccgtgatctgggggatcttgccgctggccacggtgattttgacctggatgtcgccccattcggtgctggtcgacttcccggtgtaggtcccgtctttcatggtcaagttggaactgctagttgatgatgatgaagtagtggtggagctctccgattcggtatcactcgctgcggtggcttgactttgagccgtttcctggctttggtcatgtttgaagaacattaagtaaccgtcgattagaaccgctactgacgcttcaattgaaacgattgtaatcagaaatttcttaaacatggttgtcacctcgcgttttaaattgttttttcttaacttggtaagaaccattttaaactatattaagggagaaactatgacgacgacgggtagaattgtgcccacttattttctagtttgttacgcattccacgctcttttatctgatagaaccaaaaaagccccgtaaaccggctcaagagccaatttaagtgacttagattaggttaatgatttattaatcgaccgccagagcgtcaattgggttgagggcggcggcgtgccgggccggcagccaagccgctaacaaggagatgatcagggcgattacgaagaccgtaaccacgttgccaaaggtgatttggataaaggcgtaggtggcgatcttagacagggcggcgttgaacccggcttgggccacgaaggcaatcacggtggcgacgatcgccgagaaaatcccgatgatcaaggattcggcgataaacatccggcgaatgtccttcttgctttcccccagcgcccgcaggatcccaatttccttggtccggtcggccactgacatgtacatggttacgatgatcatcaaagcggaaaccaacagtgagatcccggctaccccggccaagatgttggtgatcaagctgatgtaggttttaatccgcgagatcattgaggaaacggcgttagcggtgaagacgcgcttgtggttggtcttgatcttattgatctgcttggcaactgacttggagttttccatcgtgttcgccgtcacggccaaggagctagcgtttggcttaacgctttggtccttcatcgccttagtcagggtcttggtgttgacgtaagttgcccccaccgagctgctggagatcccggcgaccttggcggtaaacttaacggttaccggttgcccctggctgttttgggcggtgtaagaaagggtgaccgtcttgccgatcaggctcttgccactgcccttttgcagctttttggcgaccgttttttggtccagaaccacttcgccggcgcccggcttgtggccgtacttaatggaagaattggtgctggagttgttccagttggttaaagtttgggcgacggtgctcttcttgcccgcggcgatcgtgacgttggcggccgtgtagatcttttgaacatcggtcacgtcacttaagtccttgatcttttggacgtcggactgtttaaaggtggcagcgcccttactgagttcggccatcatcgactgctggctggcgccagaatcgctacccccggaagcatcgcttcccttcacgtactgggtgacgattaccgaacgggggttaaccatgtcgttaacctgcttgttaacgtagccctggaccccgttacccagcccggagaagaggatcacggcaaagaggccgatcgccgttccggccacaatcaagaggttacgggcgaagtggaacttgaagtgcttgtaggccgtcgaaagcgaagtcttaaaggacaggggctttgaggtcaggcgccccttgtttttgtcgaccgggtaggccgggcgcaggcgctcgtcaccgtcgatttgcccctcggccaggtgaacaatcctggtcccggaatcggccacgtgctgggagtgggtaacggcgatcaccaggcgtccttcggcggcgatctcatctaagatcttcaagacgtcttcggtgttttcggcatccagggccccggtcggttcgtcggcgatgatgatcttcgggtcactggccaaggcccgggcgatggccacccgctgcttttgccccccggacaattggctcgggtacttcttagcgtgttcacttaagccaacccgcttcaagaggtccatcgtccggtcggtggcttccttggcgctcagggtggtcatgtctaaggacaagcggacgttttcagtcaccgttaagtggttgatcaagttgtaagactggtaaatgtaaccaatctcgtcgcgccggtaacgatccatgcgttgttcttgactgtgatcaagcttgttaccattgatgatcacttcaccgtcaaacttgcggtccagccccccgatgatgttcatcaaggtcgacttcccacccccggattctccgaggatcgagacgaattcccctaactcaaactgcaggttaatcccctttaggaccgggaactcttccttgccgaggaagtaagacttacgaatgtcttttaattctaagtaggccattgaaacactccattctctcaaagtaaaacttaaacatttggcgttaagatttaagtatgtgtcatattgtacccgttttgcggggtatgtcaacaaagtttaacatcttagttaaatatttaacttttaaatttaagtttttcgggtataataggattctagattcaacaagtgggggtgaactcgtgaagcgcgaagaactcaaggaacaaaacagaaccaagatcatcgaggcggccaagcggctctttttggcccaggggattcaaaagaccagcgtccgccagatcagccaggagtcggggatttcttacgtcaccatgtataagtactttgccgacaaggaggccctggtccaagaggttttaaccggcctgatcgacacgtcctttgcagacgcccaggcgacgatcaaaaactccagccagccctttttgcaacgtctgcaggcgattcccaacacctcctcgctcggcgccatcaccagtcaggcttcctacgaagagctttctaagaccatcgagactaccccgaaattgcgggcccacgtccgggccaagctggatgggctgtttaccaccttcattcagattgggcgccgtgatggtttcatcaccaccccggccagcgatgaagcgatcatcaccatcctaacctcgctggtttattatggcgatgccaacggccacgaacccgaccctaagcaagccgaagggatcgttaacgtccttttgtatgggctgacggggaagtaagcagtgagtgcgacccaaccaactggcaggccgtgggctaaggataggccacaggttagcgcggcacgcggtgttctgtggccaggcttagccactaggcctgcggctggggagcacgttatcagtgagtgcggaccagccgtaaagcaggccgtgggctaaggataggccacaggttagcgcggcacgcggtgttctgtggtcaggcttagccactaggcctgcggctggggagcacgttatcagtaagtgggaaatgaccttctcgacagaccgtatggctaagctaggacgaaggttagtgcgcgatctgtgtaacagcaaaaaaagagtctcggagaagtagcttctctgaggctctttttagtttagttaagtgcttttaatgcttgttgggcaatgttgtcagccgtcaagccgttttgggccaacagttcgttgacgtcgtagcggtccgggtaagccttttgcaggccgtagttttgcacccgcacggcgctgtcaccgaggtaggaggcaatcgtttgaccgtaaccgccctctaggatcccgtcttctagggtcaccaccacttggtgatcggcctggggttggtcgagcaattcggtgtccaacccggtcaggtaacgggggttgatgaccgtggcgtcgacgccctcttcggctaacttagcggcggcttgcttagctaagccgagcaggttgccgaccccgaagatggcgactttggaaccttggtgaaccacctggttcttgttcaagtcgccgtaatcggtggtgtcagcttggccggttgtttccaacgccacggccggaacccgaatggcaaccgggtggtctggttgatcaatcgcccagttagtcattgcgaccagctcttccttgttggttggggccaagtaaacgaagttcgggatgtggctcaagaacgggatgtcgtagaggccgaggtggctttcgtcgttcatcccgtaggcgccggccaggtacaccaggagggtcgccgggtcgttgtttagggccacgtcatgcgacagttcgtcgtacgcccgttgtaagaaggtggcgtaaaccgggtaaaccggcttggcgccgtacttggccagggcggccgacatcgtggtggcctgttcttcggcaatccccacgtccatgaactgagcgccggccgcttggcgttgttcctggttaaagctgactttaggtcaaggggcgcaccctaatttttttcgatgaatttaacggcggtcccgtaggccaccaccgactgcatgtccgaagcgatcgaaccggagtcaaaccgcatcatcaccacggcgtcggcgcccatcgccgccgcctcttctttcaaacggtcaatcgcctcctggcgcgaggtggtcagcatcttggtgtaacccttaatctcgccgccgaccaggttcttaagtccggcgccgaaattactaatgatgtcccggctttgggtggtcaccccaaagcactcgcccaacacttcgtattcttggcccggaatccgttcggtcgttgtcactagcatggtggttcctcctttggtgggttggctacggttattaccttaattatcgcataattaccaacttaatggtaggggcgctgctgctttactccaacaaggacaacccacttaaagactagcgtaaattgagcgcgtcccaggccatgtgctcggccaccgtcaagccgaccagttcggcgttttgatcgagctgggtcaacaggttcgccacttctggcaaggttaattggcccacggtggccgggaagtccgccgggtcggtccctggttcggccgggtaaattgagcgaaaagccgtgggcaacaaggcgtcgaggtcaaagtgaacggccacctgcttgaagccgtggccgcggacccaatcactaagggcgttcggagcttcgcgcagctgctttggcgtcagccgttggacctggtaatcgaaaacgttgtggtccatcggccgtaggtcctcttcaatcaaccccgccaagatgacctggtcgcttgcaagggggtggtgggcgttaaagcccggcgcccccttgcccagcagggagctgaccaccatttcgtggaggtggtgggactcctcggtcgtggagatgtcggggtgggtatccagccaaacgacccccaggtcccgaccgtaacgcccactcaaataatcaaagggggccaggctgacggcgcagtcgccccccaccatcaaaaccttatccggttgcttggtggctaagactccctggaccgccgttagttgaccttgcaaggcctggtaggcatcgatgccgtgttggcgctccaacacctcgggggcattaacgtcggcaaccgggatcgtcaccgttggtaattattcagccggcacgatcaaatccattaagcgggtccctaagacgtagttggggttcaccccaccttcccactggggcaagacaatctttaagcgcttcatttgatcccctccattaattcttcaaccagctcggcaaccgttccaccgtgcttgatcaagtccagcccggtgttggtggaaataatgttgtcgtccacttgccccaggcgcaggcccggcaacatcccgccgcgttgggcgattatttggtcaattgcccgtccgtcattggtttccttaaaccgggccgctagttgcttagcccccggggtcattaacgagcgctggtcgtgggagaccaaatcgacttgatcgtaagaccccgccaacagggtctccttggcagccggggcaaccggggcctcagcagtgactaagaagcgggtccccacgtaaaccccttgggcgccgaggaccagggccgccctaaccccacgggcgtcgttgatccccccggcggctaggaccgggatcgaaacggcatcggccatcgtcggcactaccgtgaaggtcccctggaagtgctggggcaagatccccccttcgtcgtagccggtcgccactaagatgtcggcgccgtaggcctcggcggctttagcattagccacggttggcgttagtggccgggccaagattaccccaccgtggtccttgatccgccggtaaaccgcctggtcgggttcaccaaccacggcaaagtagcggagcccgttggcaaaggccacctcaagcgtgctgttcatgtggggcgccgggtccggttccaacaccacgttgataccgattggctggtccgtcagggtgcgcacttggtccaactgggcttgcaactggcgctcgtgggccgctgagccgtgcaccatttcgctcaggccggcgttggggcccaacaccccgagggcaccggcgttggcgacggcggccacgaaccgggcgtcggtcgcccagttcatcggggcctggacgagcgggtacttggtgtgcaaaagttcggtaacggatgacattggtttcctccttaaatttacatatcgctaattaacgatctaacggggtgaaaattaaggaaccacccttacagtgattcctcaattagccgccccagtgcttgcacctgggcttcattacgccggtagtaggtccacttgccgtgccggctggaggtgagtaaccccacctcttctagcatggctaagtacgacgaaatcgttgattgggccaggccagccttacggacgatgtcgcccacgcagatgccgccgaagtggtcgagttcgtattgaaccgtctcacaggttacgacgtcgatatgggtgagcgggtcttttaaccagcgcaagatatcgaggcgggtttggttggccagggccttaaagagcttttcatttatttccatggtctgattatagatcggcttttatcgatctatcaattccccaccgctcactttccgttaacgatctccacgaaccggctcttgagcgtcgtgtccttagtgaccgtccagttatccggcccctccatggtctggttgatcaagaccaccggcttgccctcgtgaaaggcaaaggcgtaagtggtccgccccaggtccttgggctggttgtaattgtagacggcgaccacgttgtaatcgtaattaccgctcccggtgtccgtccaccccatcgagacgctacgcatccccacgaaggcggcgctaaagccggtcgggtaactggttcccgaggcggttaccagatcgctgttaccgttgtacttggcgtaggtttgcttgtccgctgccccccacttagccatgaaggccgccagttggttatccttgccctggttccagcgggccgtcgttgacgaattggtggttgaactttgcgtcaccgttttaatttggttgttgctgctccccgactccatttctgggtggtgcttcggcccgcttggcaagaatgcccataatgccaagagggccaccacggccagggtaaagccccctaggcccagccatctcttcttcattccgatcgcctctctcgctctcttcttaattcgtggttattggtaatctaggttatcaaacttggtgtcgacgttatccttggccagctgttcggtcgggtaaccgacttcttgtacctgaacgtggcccccttcggctagcaacagcacccgggtgtcttggccgttcaccttttcggtcgtcacgccgtagtagttgtggggtgcggtttcttgcaaccaagaacgaacgctaaagtactggataccgttatgggtaaaggcgttcccctccgaccaatccatcgacttaaactgtaggtcctggctcgggttttgcgggatttggtagtcggactgacgattgtaaaggaccgtggtgctggaggaaccgtcctcaatcgtcgtggttagctcgtggtcggtaattgtgaccttggtgacggactggttgtcgttgacgaagtaccaagtcccccgggtggcgcttggcgttgcaaagtaaccgttacgcccatcggaagtcaggtcgctggtcgcgctactggagttggcgctagttgacgtactaccagaggtggcactcgtcccgttggcaatccggtcgaaggcgtcgcggacgctggcgttttgggtcggataaaagtccggaccgccgttagttgcttggtcaaccagggcgaccggctggccgtcgtggaaggcaaaggcgtaggtgatgtgcttggcgccggcgaagtcgtcatcgttgtagatggcgaccacgttgtaatcgtacttgcccttaccgcttggcgcccagccaatcgaagcgctggtgctgccgttaaccttggcctaggtaaagttcttcgggtacttgacgtccaacttagtctttaaagcggttttgccgttgtacttagtgtaggcctggctcattgtcggcgcccactggttaatgaagctttccagctggtcgtctttttggctgttccagggcgtagtttgcttgtggctactcgaaaccttttgactggtgctcgaagacgactagctgacctgcttggccgtagagttgccgccgcacccggccaagagaatggtcagggctaacagcccggcaccgatccgtactttcttcatttgtttactcccctaactgatgatctttacaggagataattatgaatcatttatgaagaattctcaaactaaattttcgtttttatcaacccttttaatggcacaaaccgctaatgcaaacggttgacatagaatttcgctctcccagcacccatcagattagctttagtttttctttacctttgactaatattatgcacgaacaagactcccggttgatcagaaccactaatcagaacggcgccgcttcgttaattaaaattattattaaaaccgctttaaaatttgctaattgcgcctacaattaagtcaaaggggggattaaagatgccaactaaatcgttatcgttagaagaaattgcccaagaagacgatcaaacccgcctcctgaccgaactacaaaccagtcgcaccggcctgaccaaggacgaagttacccgccgccaggcccaagacggccccaacgtcctcaaacaaattaagggcgcctcctggttaaccaaattcacccaaaacttcacctcgatgatggcgatcctgctctgggtcgccggggcgattgcctttgtcgcccaactcgaggaactggggattgccatctggctcgtcaacatcatcaacgggctcttttccttttggcaagaataccaggccggcaaggaaaccgacgccctgtccaagatgcttccttcctattcaagggtcgtgcgcgacggccacgaccaaaaggtactcaccagcgacctggtcgttggcgacatcgtcaagctcgaggagggcgataacgtggccgccgacatccggctccttgcggccacccaggtccaagtcgaccagtcggccttgactggcgaagtcaacccggtcaacaagggggcccaggccattgacccaaccggcaagaaccactttgagttcggcgacatcgtcttctccggcacctcgctggtcaaaggtaacctggtgggggtggtggtaaaaatcgggatggccaccgacttcggtaagatcgccgaactgacccagcaggtcaaggaagacatcagtcccctacaaaaagagctcaacaccctgaccaagcaactctccgtgctggcggtttcgatcggcctgatcttctttttggtggcgaccctcttcgtccactacccgctggtcaaatcctttatcttcgccctcgggatgatcgtcgcctttatccccgagggactgtcgcccaccgtgaccctctccttagccggggcggtcaagcggatggcgcggcaaaacgccctggtcaaaaagctggccagcgttgaaactttgggagccgcttcggtgatctgttcggataaaaccgggaccttaacccaaaaccaaatgacggtgtcgagcctgtggacggtcgccaagcactaccaggtgaccggcgagggctacgaggccaagggcaaggtcgtcgatgggccccgccaggtcaacgaagagaccgacgccgatttgtacgagctcctgcgcggcggtttgttagccgataacgcccggctcgttccgcccgatgaccaccacccccgctacaccgtcttgggcgacccgaccgaggcctgcctggaagtggtcgccaaaaaggccggcctaaacgcccacgacgaacgccaagtcagcccccggcaacgggagctcccctttgattccgaacgcaagatgatgaccgtgatcgtcaaagcagaccccacccacccctttaacacctacaccaagggggcgcccaaccaggtcctcaagcactgcaccagctaccttaaccacggccaggtcctggcgctcaccgacgaagttagacaacaaatcgacgccgctaacgatggttacgcacgccgggggctgcgggtcctggcggtggcggcccgcacctatcagggggacccgagtgacgccacgatcgctaacgttgaaacggggctgaccttcatcggcctctccgtcatgttggacccgcccagaaaggaagtcgccgtggccgcccaactttgccaccgcgcccacataaagatcatcatgatgaccggtgactacagcctgaccgccgagagcatcgcccgccaaatcgggatcgtcctccccgaccaaccagtcacggtcatcaccggcgaccagctcaaaacaatggccaaggccgacctcaaacaagcgctcgccggccagataatcttcgcccggatggctccggaacaaaagtacgacgtcgtcaccaccctgcaggagatgggcgaggtcgtcgccgtcaccggggatggggtcaacgatgccccggccctcaagaaggccgacatcggggtcgccatgggtttaaccggaaccgatgtggccaagcaagctgccgacatgattttaaccgacgacaacttcgcttcgatcgtggcggcgattaaggaggggcgcggggtgtaccaagacatccgcaagttcttgttgtacatcctcaactccaacacccccgaagccgtcccgtcgctactcttcttgctgtccggcgggacgatcccgctcgctttgaccgtcatgcagatcctatcgattgacctgggaaccgacctgattccggccctcgggctggggaaggaggtcgccgaggccagcgttatggaccggccgccccgctccaaacaagagcatttgatcaccaagaacctcttgctcaaggccttcacctggtacgggctgttgagttcgctcctgtgcgtggccggcttcttctttgccaacgccattaacggtcacgccttcccggccctggccaccagcggctttgactaccgtcaggccaccacgatgaccttagcggtgatcatcttctgccagatcgcggccgtcttaaacatccgctacgaaacccaatcggtcttcaaccgccacttcttcgacaactcaatgatctttctcgggatcatctttgaagtcgtcctcttgttatgcctaacctacgtcccggtgttacaagacgtctttggcacggtgccactagggcccgctcagtggctgttcttactgtgcatcccgctgcccctgatcctgcttgacgaagggcgcaaatggttgattcgccaccactaattctatagaaacaaaaaatcgtctcgtacccttgaaaggtaggagacgatttttttgtaactggaccaccgccgttatttccggccaatatttattaaattacaagcacgtcaccgccgtaacaatggcaaagacaatccccgggacgttggcgataataattggccaatcccttttcggggcgttccaatcaaaaacagcccccaccacctggcgggagccgttatttaaatcttattcatcaatttcgtttgcctgactcttcgtttcggcagcagcgaagcgttcgtactcagcggccgcagcctggttgtcagccttcttcaagtggaagagggccttccagcagaccacgagtaggatgatgaccccggccgtgaagatcaggtcccatggcatccgtccccataagattaaagaaatcagcttttcgtggtaaaaggacatttgccgggcgtgccagtagccgtacttcagggcgtcggctaactggagttgcccgaccggcattagggtggcaaagaccatcccggctaagccgatgttcagcaaccaggcggaccagcgaatcgccttttccattttagccgtccagaattccttgactgtcacgttgcgtaacacgtacaggataatggcgatcgagaacatcccgtaaaccccggccatggaaccgtgcgcgtgggcggccgtccactgggtcccgtgttcaaagtagttgatggccggtgcgttgatcaaaaagcctagcgccccggcccccagggtgttccagatccccgtccacatcaagaagatgaaggtcgtcttatacgggaagttgtggtacgtgtcctggtaaacccggtagtgggtgtaggcttcccacactaacagggacagtggcacgatttcaagggcagaaaaagatgccccgagggccaaccatagggagtggtcccccatccagaagtagtggtgaccggttccgaccaccccggaaccaagcagcaggatcaattggaagtacagggcccgaatcgttgacttaatcgtggtcagcttcatatcaactaacagccaacccgttaaaataacggcaaaggcttcaaagatcccttctacccagaggtggacgatccaccagcgccagtaatcggcgaaggtgacgtgtgaatcgggcatgataaaaatcgacgcgcagtaaaaggctggcacggcgatcgcccctaagaagagcatcgtgaccaggcgggtgcggggttggttatccttacgtcgcatcgccgggacaaagccccgcattaacataacgatccacaggaccatggcggcgatcagcaggtactgccagaacttcccgagttccaggtactcccagcccccgttaccaaagagccaccagttcttgtttaagacgcccaggtcggtcaaccattccccgagcatgctgccgcccaccacaaagatgagcgcccaaaagaggacgtcgactaagatcccttgacgaaccggttcccggcgcaggacccggggcacgatatagattccggcccctagccaggtggtggccacccagaagatgaccaactggaggtgccaagagtgggccaggttaaacggccagatgttttggagcgcaatcccaaagaaggtgttttcgacgtagtagtgggccatcaattcacctaacaggatttggaccaagaagagcaccattaccagggcgaagtacttagccgtcttccgctgactggtggtgattggtaaggtatccggttcaatgattgggacatccttttggtactgggccttggattcgaagttgtacttcttttgaacccagatggcgatcgccacccccattaccaagagggccacggagatccccgtccaagtcattgcctttggcgtcatgacgttgccggcttcgaggtcatacggccagttattggtgtatgagtaggaacgtcccggccggttggtggatgacaaccaagccccccagaagaagaaggcggtcagttggtcgaccttgttccccttgaccatgtattcgttggtgcggttcttgatcatgttatccggcaagccgacttgcttaggattgttgataaaggccttacggtagtacttaagcaggtactggtacccggccgtctgggccttggttaaggttaattccttatccttagcgttatagcggttaacccggatttcctctttaaccttccccttaattccctcttgttgcagggtggtcaacttattaaaggacttgccgtacagggttttggcgtagtaacggtacatcccctgcaagtaaacgtgtagcgcctgggccgtgtaatccggtcccaagtaagccccgtttcccaggtaggtcccgtagtcagccaactggtacttttcgtaggtcgcctgaccagagattagctgctgtttggaaaccagcgtggttcccgcttcggtcacaatctttgctggacggggtgcctcatttttaaaaatgagcaagcccccagcaattaagatggaaaagacgaccactagcgtcacgattaacgttcgcgacagccgccgatattgatcttgcatcttgcttcctccctaaaaataaatcaatattaattcacttaagattagctaaagtgtgacggtctgtcaactaattttggaatattttgatattcctcaattttagttttgtcttattactccataacttgataataatcaataaagttacgtccgacaattttcgttccttcttacttaaccacggtaacaagaagcgccccgcacctttataagagtgcgagacgctttttaattaggctataactatggggacgaattttgggtcacacactatttgtcaacgactttactttctacttccagaaaaccacacccgacaaatctaaaatttgacgcaatagacgccgattcgctaaatacgtcctgtttgatcgattgggtcgcacttccgttttgcgcaaatctaaatatttgtcctgtgtctagctctaaatgggcgtaattaaaaaagcgagtcaggaatcaaatcctggctcgcttttaattttgcaatgttactcagataacgtgctccccaaccacgggtctagtggttgttccacactccggcgcagtacaccaatgggtttcagtcgcttaccaaggtaagcattcctgaaaccctattggtgcttgcgggggtgggacgacgaaattagaaatttctgtcccactccctattcccactcaatcgtggaaggcggcttagaggttacatcgtagaggatccggttaacgtgatccacctcattgacaatccgcaccgagatcttttgcaagacatcccacggaatttgggcgaagtcggcggtcatcccgtcgattgaagtaacggcccgaatgccgaccgcttcgtcgtaggtccggccgtcacccatcaccccaacggagcggatgcccggcagcacggtgaagtattgccagatactttcttgcaggccagccttcttgatttcttcgcgtaagatagcgtcactttcccggacgatttctagcttttcgggagtgacttcaccaagcacccggattcccaggcccggacccgggaatggttggcgccagaccaggtcgtgcggaatccccagcttttcacctagttgacgggtttcatccttgaacagggagcggagtggttcgatcagcttgaagcccatcttttccggcagccccccaacgttgtggtgcgacttgatcgtctgggcggtgtcggtcccggattcgatcacgtcggtgtacaaggtcccctgggctaagaaatcggcgtccttcatcttcttggcttcttcgtcaaagacggccacgaattccttaccgatcgtcttgcgcttttgttcagggtcgctgatccccttaagcttgcccaagaagcggtcggcggcgtcaaccttgataatgttaaccccgaggtcggcgcttaaggccttcatcacggagtcggcttcattcttacgcaacagaccgtggtcaacgaagatacaagtcagttggtcgccgatcgccttgtggatcaaaacggcggttacggaagaatccaccccaccggaaaggcccaggatgaccttcttgtcaccaacggtttggcgaatctcgtcgacttgcatgtcgatgaagtcgtccattgaccagttggccttggcgccacacacgtcaaaggcgaacttctttaagatgtccagcccgtattcggtgttacgcacttcggtgtggaattggagcccgtacagcttttcggcgttgttagccatcgctgaaatcgggcagttcttgctggtggcgaccacgtcaaagccggctggtacggcggtgacccggtccccatggctcatccaaacgtattccttctttggtaagcccgcaaacattacggcgtcgtctttagtcacttcaatgtcggcacgtccgtattcggaatcatcggcggcttccaccttcccgccaaggtcgtgagccatcaactgcatcccgtagcagatccccaaaatcggaatcccgagcttgtagattgccgggtccaccgtgaaggccccttcgtcgtacacactgttcggccccccggagaaaatgatccccttagggttgatctgcttgatttcttcggccgtgatcttgtgggataaaagttcggaataaatcccaaaatcacgaatccggcgggtgatcaattggttgtattgactcccgaagtcaagcactatgatcttgtcgaaggcgtcaagattaatgtttgccaaattttccactcctttatattatcttcaaacgtcctaaccattgtacgggtttcacccgggtgggtcaatggtgaagggccggttttgcggattctttggcaaattaacgaagtgctccctagccatacggcctgccaaggaggttgggttgcacttctttccttttatcctttcttaaggaaggctaactttttggataaagttggggggatttctcgcccctccccggttaaatcgctacaattagttgatacctaaatcctttctaaaagcttgctataatgagagttaatttactaaaggaatgatcaataatggatatttacgggacggccaccccttacctgccccagctgctcgattttgtgatggaccgggtgcgcgacctctccaacaaggaggtcgccgccgaccgtcccaagctgtacgagcacctgatcgggcgggtcaaggcccaggctagtatggaagaaaaatgccgccgcaagggctacccggtcacgccggaatcggccctgacgaagtgtaaagacgcgattgggattcgggtcgtctgtaactttatcgacgacgtttaccgttcaattgaccggatcaaggccgccgactggtgcacggtcgtcgaagaaaaagactacatcgaaaacgccaagcctaacggttaccggtcctaccacttaattttagacgtgcccaccgacctccctaactacacgggccacaccccgagccactacttcgtcgaaatccagttgcgcacgattgcaatggattcgtgggcgtcattagaacacgaaatgaaatataaacaccacgtcaacgacccggaacggattgaaaaagaactccgccgttgtgccgaccagctggcctcttgtgacgtgcaaatgcaaacgatccgccagctgatcaacgaaagtaattaaggaggaaccgcccatgaatatcctgcttgcggaagacgaaaagcagctatcgcgcgccctagtgacggccatgcaagcgaccggctaccacgtcgacccggcttataacggtcaagaagccgtcgacttagctgggcaacgggcctacgacgtgatcatcttagacatcatgatgcccaagttaaacgggatcgaggccctaaagcagcttcgccaaaccggtaacaaaacctacgtgatcatgttaacggcgatggccgaaattgacgataaggtgactggcctagacgccggggccgatgactatctgaccaaacccttctccttaaaggaactcctagcccgcttacgatccctggaacggcgcagcgaggattatcaagaagacgtcttaaacttcgccgacatcaccttggataacgacgaacaacgcttggaaagccacaactcgatttccctatcaggcaaggaaaccaagctcttggcctacctgatgaaaaacccgggcaaagccattgaaagttcaatcctacttgaccaggggtgggataaagacgacgaggccgacgaaaccgacctttggatctacatctcctacctgcgtcaaaaactccaggccgtcaacgcccacgtgacgatcgtcggtgaaaagggcggtccctttacccttagccagctagcttagggggtggcgacgatgattcaaaaattccggcgccgcttcatcgccatttctacttgctccctcttcgtggtcctcttaaccatcctggggggcatgctgggggtctcttattacaaggcttcccaacaagtcaccaacgttttaaatgtcctcgctagccacgacggccaaatcgataaggatagcgtcacccaggtcaccgtacaaaaacgctttggtcccaacaccagtaaggaaagcctctttcagtaccgctacttttcggttttctttgacaaatccggtgacatcactaagatcgatagcggccacatcgccacggtcgaccaagacgcgattaccgacatggcgcactgggcttacaagcaaaagaaagaacgtggccataccgattacggcggtaccacctacgcctacaagctaaccaaaaagtctaacggtaaggtttcgatcatcttcttggatgaatcggtcatcatggcgtcagccaatgagttgatgaagatcgccgccgccatgggaattgtcagcctgctcctcttcaccctggttttgatcgccttttccaaccgggcgatccagccgatcattgaggccgaaaaacggcaaaaggaattcatcaccaacgccggccacgaattaaagaccccgctggcgatcatcgaaaccaacaccgagttatccgaaatgatcagcggtgaaaccgagtggacgaccagcaataagcaacaggtggcccggttgacccggttaatcaacaacctgatctccttagcccgcttcgatgagcaaccggaaatgacgatcgccaccatcgacgcctcggccgccgttcaacgggccgccgacagcttcgaggcgatgatcacccacgaagggaagggcttttccaccaatatcgccccaggcgttaaggtccgcgccgacgaaaactacttctacgagctgtgtaacatcttgctcgataacgccaataagtactgcgacgacggggggaaggtttcggtcttactacgggaaaacaaaaccacccgtgccgttaccctagaggtcggcaacacctatgcggagggcaaagaaattgattacaccaagttcttcaaccgtttctaccgcgatgacacctcccacaattctaagaagaggggctacgggattggcctgtcgatggcccaaaccctggttcacgcctttaagggcaagattagcgctcgctacaagaaccagaccctctacttcacgattcgcttgaagatgacgaagtagaagtgagtgcgaaccaacctcctcgacgggccgtatgtaagatcgggggaaggttgatgcggcacgcatcgttcttcacccgtacttagccactaggcccgtggttggtgagcacgttatcggaagtgcgactcaatctatcaaacaggccgtgggctaaggataggccacaggttagcacggcacgcggtgttctgtggtcagacttagccactaggcctgtgattggtgagcacgttatcagtactgcagcatagaaataaaagaccgaccggcgtttttaaacgctaggcggtctttattttcacgtggaactaatcctcacgtaggtacacccgatcaatgtagtggtgctccgttttatgcaaaatcacgtcggcccgggtccgagtcggcaagatgtagtcgtttaagttcggtaagtcgacgtctttccaaacctgcttggccattttaaaggcctccgcccggtcgccctgggcgtacgggtaatagtagttggtcgggtcctgaaaggcggtgtctaacaacatcccgaaccgctctaggtaccacttctccactaggctggcgtcggcgtcgacgtagatggaaaagtcgaagaagtccgacacaaacaggcgctgggtggtcggtagttgcaagacgttgatcccctcgacgattaagatatcgggcttgtaaatcgtttggggatggtcctccatcacatcgtaaaccgagtgtgaataggtcggcgccgttacctgatcctcgccggcgttgacgtcgttcataaaggtcaggagccggtccatgtcataggattccgggaaccccttgcgcgccatgatcccgcgccgttttaactcggcgttggggtacaaaaaaccgtcggtggtgatcatttcgatccgccggtctggcattaagcgcttgagcaagatctgaagcagccgggccgtggtgctcttgccaaccgctaccgaaccggcgatcccgatgatgtacgggatccggcgcgaggacttgcgcaagaaggtcatcttttgcaactgcatttgctggtagttttggtactggagttggatcagcttaatcaacggcaagtaaatgtcttggacgtcgcgcagtgaaatctggtcatttaaggacttaatctcgtccaggttttcctgggtcaagaaggtgatttcgctgggaaagaagctgtgccaggtttggcggtcaaactgatcgtaattaatccattcgtccattatcatttctccgttcatttggatagcccttacattttaacacactcaagtaattacgtgcattcttggccaattcccggtaggatagactgccaaaagggggaattgatttgtcactaacatccatcgccgttaccaaacgcctagccgactacccggccatccgggccctgtaccaacgggccttcccgcgcgccgaacaggttccctggttctggttgatgtttaaggctaagcgctcccgggcccacttcaccgcctattacgatggtgaggacctggttggcttcacctacttgatcgtcggccacaacgttaactacttaatgtacttagccgtcaacgaccggatccgctctaagggctacggtacccagattctgacccacttaaaggccacctacccggcccaaaccctcgtgcttgaaattgagcaccctgaccccaaggcaactaacgccaagcaacggttcgcccggctacagttttaccttaaaaatcactttcaccaaacgccacacctggccgctgacgggccggtgacctaccaactgctggccaccgatcctaaggtcgaccccgccgtgatttactgccaccacttccgctggtttgcctggccgctggggtggttgtacccggcgccaaaacagattaaataaattaagaagtggagaacaaaatcccgcagcagatcaaccaagcttggttaatttgctgcgggatttttcacttgaggttggggtgggtcgcacttcttatttcgtcgggaacttcagggtcttgttggcgatttctggtgcgtcggtcgtgtaatcatcgaacaacgacttccaagcgttttccgccagcagactcgtcttcttcttttgttggaccttctttaagttggccaaactcttttgggcgttgtaagtgtaactagacttgttaaccttggtgaagcccggtagcttgtagaagcgtaggaggtcaccgttgattaccttgtcggataaggcgaggtcggtcgtgacgtacttttggatcttgtcgatctgcttcttttggctcgccgtcatcttagtgatcggcttaccagtagcggtgtagtagtagtcaccaccgtacttggtgtaggtcttagatacccagtcgccatccctaaacggcacgatctggttgcgcttggtgctcaacaggtcctggccgaactggatgtacttgtccgacgagatcccgaggaggtcttcaatcgttggcaagacgtcgatttcacccccgtaggtgtggtcgatgccccccttgagtccttccatgttgatcatgaacggcaccttttggaacatggccaagtcgtagttagtaactgacttcttgcccaagatcttggcgatcgccgccttgtggttgtcggaaatcccgtagtggtccccgtacaagatcaggacggaattcttacgcaagccggtcttgtctaagtaattgagtagctccccgatcgattggtcgaggtagtgggcggtttgaacgtacgggtcaaccgtgtcgtcacccgtcgacagcttcgggaagtcggtgtcttctctgtggatgatgtacgggtagtggttcgtcaccgtaatcaacttagcgtagaacggttgcggcagctgttgtaaatattcggccgtgtacttcaagaacagcttatccttggtcccgtaaccgacgtcggaatccttaacggtcgggaagaagtctttagagaagaagtattggtagccaaatgacttgtaggcgttgtcccggttccagaaggatggcacgtccccgtggaaggcggccgtcgagtagccgagcttttgttccagcagggccggggccgcttggaaggtgttggtggtcccgtcaatcgtcatggccgaaccttctggcagaccaaagagcgagttttccaacatcatttcggcgtcggacgtttttccctggcctacttcgtggaagaagttgtcaaaggccaacgtgtcgctagagtggtagagcttgtttaagttgggcgttacttcttggccgtccaccttataatcgattacccactgctgaaggctttccaggtggatgatgaagatgtttttacccttcgccaccccttcgtattgaatgtttggtgacgcgtagttggacttcaagaacttctcgaccggggcgaggtccttggcactggccttggccttgatcgcactggtttgggtggccttgatcccatcgtaaatcgtgtaggcttccagccccaagtacttaacgatgtagttagagtcaaaagttcgggtcagaagctggctccggtcgctttcggccatcccgagattggcgccaaacaggacaaagcccaacgccgtaaaggtcgcggcgtagcgaattttaaagtagcgcatatcgacgcgaacgaagtggaagagcaagatgacgattaaaatcaccacgtccaagtagacacaaaagtcgcttggtttcatgatttcggccagactcttccccaggttattggaggtcgaccccgaccccttgatcacgttcatcgtgatgaagtcggaaaattcacggtaatagaggatgttggcaaacagccaggtggacaaaagcaggtccacgattaccatcacccaataggataaccgcccgcgaaagtataacccaatccccaagaagacgattgcgctggggatcgtgttaaaggcgagcaggaattgctgcaccgccccggtcgctcccagagtgaactttgtttggtacgcccagtaactcttgatcgcaaacaagagcaccgttaaaagaaagaacccgagcttggtattgaagaccgcccggacctttcgcagcgctgttttcataatttgtgttcctccatcaaaaatatcaacatcctctatcatacaagaattccgggcattggcaattacttgaccatttttttcgtaaatgcttaagaatttcctatttcctgggaaatatttgaaaatagagcggtgccccgccgttgatcccgggaaattaaccatttaccaagccgctggccgggtgtatgatcattggcggactttataagagaaagaagaatatatacatgcaaatttcccaatcccgggccaacctgatgctggtcctcgttgccattttgtggggctcctcctacgtctttgctaagcaagttgtcgacgccggcatgcagtcggggctgatcaacggttgccggggcaccttttgcgttgccgccggttacctgctcttccacgccaagatcaaccagatgagccgccgcgacctcaagatcgggctgaccgccgggttgattaactttttcggctactacctgcaaacggccgccctgcgctacaccaccccggcaaagaacgcttttttaacgaccatgtacgtggtgattgcccccttcatcctctggttattttggcaccaggccccgcggcgtaaggattacttcgccatcatcctagccgtgatcggcatggcgttgctgtccggaatctcccctgctaacttcaccctccagttgggcgacctcttgaccttaatctcagcgatcttttgggccctgcaattaatctactttgccaagtttgcctccacggtctcctcgccctggatcgtgatctttttaatcggactagtgcaggggagcctcggttgggtttgcgccctcttgtttgagcggccaagctttgcccacgtccactggctccaggccctggttccgttagccatcctcgccatcgtggttaccttcttagcccaggggatgcaaatcaccgcccagcacttcaccacccccacggcggccgggatcatcctaatgctagaatcgctctttgcctctttgatgtcggtggcgctaggctttgaccgtctcaccccacaattagtcatcggcggggtaatcctaattttggccaacctgctcatgcaactcgacttggcgaagatgccgtttgtcaaaagaatttcatcaaattaaaaaggaccaggagaaatggaaattccccctggccctttttgttgttggctgtcatgcataacttacggcctgctggacaggctgggtcgcactcacttcgtttggtacaattcccccggaatctggccaatcaggtccgtaaccgggcccacactggtcacggtcagggcgtgcatcgcccgtgaacaaatcgtgtagaccaactggcgttccgcgtcgccttggtacttagcctggttggcatcccaaacgatcacggcgtcaaactccagtcccttggctaagtaagacggtaccacgatcgtcccctgggccagccgttgattttcggtctgaatcagggtgaccgcttgcccggcctcctttagaagggcggtgatcttttcggcgtcggtcagcgtcttggtgatgatggcggtggtgtcgtgatcggcttggtacttcgctaaggttgccacaacttggttaacggcgtcctcttcacttggcgccgtcagcacccgcggcagttccccttcccgttcaaaggcctcaatagcttccccgtcctttaggattgccttagtaaagttggtgatctgcttggtcgaccggtaggaacgggtcagctgaatgaccttggtcttttccggttcaaacatcgtgcccaactgttgcaagaggctccgggcgttgttgtgggtgaaaatggcttggtttaagtcacctagcagggtgaagcgggccttggggaagcagaacttgaggtaggccagctggaaggcgtcgtaatcttggacctcgtcgacaaagacgaagcggatctcgcgttggccccgcttaccggtcaagagatcgtataagtacaggtagacgctgattccgttggcgctcatccgcttttccttgagggccgctaactggtcgtcaacgtagcccgcccattcgtcttcggtcaggccaaagtcggctaacttcactagcttcggagtcacccggagtaggtggatgtattgggcgttgatgttcatccagcggttatggtcgatcgcctttttaatcggcttgaaggcctccattacgatccggcgggccaggtatttgttttcggcctcttcgtccttaaactcgccaccgtactcgtggtaaatgacgtcgagctcttccttgcttagggtctggatccgttcttcgacccacttggagcgcatctcaccagaaatgcgccggttgagcatcttaagcagctcctgcttggtagcgtccagccggttccccaggttgtagttttggttaaaggagtagtagagctcggcgatcttgtccttgctaaagaaggccttcttgttaaacatcaggttcttaaagcgcaggtggccatcgcggcctaaccgcttggcgtagcgagtaacggcgttaaagtaggtcaggctggttaacagttggctggcccgggcgttgaccccctcctggtcggcgtcgaagcgttcctggattgaggcgacttgtaagcgcggcacccgacggttaacgtactggtagtaggtcagctgcaccatgttgtgttcccccagttccgggagcacctggtcgatgtagtcgttaaagagctggttggggctaaacaagataacctgcgaggaattgaggttgccccggtagcggtacaagagccaagcgacccgctgcaagacggccgccgtcttcccactcccagccgccccctgcacgaataacaggtcggcgtcggtattacgaatgatccggttttgggtccgctggatggtagtgacgatgctcttcatcttggtcgacgagtggttgtttaaggccgccaagagcatttggtcggtcaccgtttcggccgtatcgtagagggtcacgattacgccgtcttcaatttggaactggcgctttaacttcacattgacggtctgttggccatcgggggtgtcgtaggaaacctcgcccagttcgccctcgtaataaattgacgagatcggcgcccgccagtcgtacaccaaaaagtggtccggcgagtcggcaaaggaggccaggccgatgtaaatcgtttccggggtctggccagcttcttcggtgaaatcaatccgggcaaagtagggcttggcctcgaggcgccggaaggtttctaggcggtcggcggcgtgttgccaggagttttcccgctcatcgaggagctgctgttgggcgcgcaccgacatcgccgtgtccatcatccccgagtaggtggtggtgttcatgcggatctcgttgaagtccccgctaatcgtatcgatgtcttttttagcggactggatcttttggcttgcctcttgttcggcggccttaatccggtcaatcacctggtccaagtgggcctgttcacgtgcttgggttgcgtcagtcaaatcgatcgctcctttttgcgtaaaatcaatctaattattatagcacgatcagcaatccctttccgctccaacgctcttcaattttggtaaagcttttggtattaatgattaaattattcgccctaaccatcatttccccctaaaataagggtattagaactttagaaaggaagccttccctcatgctcagccaactcacctatgggctcacccacattccggaagtcatcattccgctctttcaatccgtcggtaactgggggtacctgtgtctctttttgatcacctttatggaaactggtttggtcgttttcccctggctgcccggcgagtccttgatttttgtggcgacctcgctatcggccgtttcgaccaaccaaatccacattgaaatcttgttgccgggcttttttatcgccgccttgctgggtgatacggtcaattacttgatcggcacccggctaatcaagctcccctggctcttcaaacgcctggatggccctaacctggagcgagcgcggatcttctttcaacgccacggcattaaatcggtcatcttcggccgcttcgtccccctgattcgaacctttgtccccttaatcgccgggtcctcgggcctcaaagcccgccgctttttgatcggtaacttaatcggcagcgccctgtgggtcttgttagccggggtggccggctactacttcggcacgattagtttcgtcaaggaccaattctccctggttttactagggctaatctgcgtctcctttttgccggccgccatcgtctgggggatcaatcgcttacgccgccacatcatcatgaaaaagggctccttttaaaaccctcggttccgcatttcataatgttttctggtatacttacaattaaatgttaggcaccccaaggcgctccgccggcgggtgccaactgttaattcgttacgattgtgagggagaaaaatttatggcaattaacgtctactttgttcgccacggccaaacctacttgaacctctaccaccggatgcaagggtggtccgattcaccgctgaccgaaaaggggctggctgatgccgcccgggcgggtcaagccttagccaaggttgactttgactacgccttttcttcggacctgaagcggacgatggaaacggcgcacgaactgttagtcaaccacccgggtaagctaaccgacgccaccccagacccggcttggcgcgaagaattctttggctactttgaagggctcaattccgatgccacctcctacacggtgtcacgggaattccggacctttgaagaaatgatcgccaactacggtgtcgaagctacccgcaacaagattgcggccgccgacccgttcgaacaagccgaagacgacgacgccttttggaagcggttggaaccgggctttgaaaccctacgccaactaccggacggctccaacgtcctcgtggtttcccacgggatgacgatccgctccatcggtagtcgccttggcggggcagagtacactgcccaaccgcaaaacggcgcgctggccaagctggtcttggaccaagacggcgcccacttcgccttttacaatcaactccaggttcctgaatagatagggggaaacttcacctcaatggataccaccgttcccagtgaaaaagtgattatcattggcttaaacaccggccaggccaactacgagtactcaatgttagagctggccgaactggcccaagccaaccacatggaagtcatcgaccgcctcgaccagtccctcgaccggcccaacgccgctacctactttggtaaggggaaggttgaggaactgacccagtttgctacggccgagcaagccaccacgatcatcgctaacgacgagctgacgcccagtcagttagccaacctaaccgaagccaccaaaatccgggtgatcgacaggaccgccctaattttggagatctttgcccaacgtgcccagagccgggaagccaagatccaggttcaaattgcccagcttcagtaccgcctgccgcgcctacacacggcggccaaccagtccttagaccaacaaaccggtgggggggctgggtttgccaaccgggggtccggggaaacccagatcgaaatggaccgccgggtgatccaaaagcaaatcgcccacctacgcaacgaactcaaggaaatcgccaagtccgaagaaaccaagcgggccaaacgggaccgggatacgatccccactgcggccttagtaggctacaccaacgccggtaagtcgacgatcatgaaccagctggtggaacgcttcggggtctcgtccgaaaagaaagtctttgaaaaggacatgctctttgccaccttagacacctcggtgcgccaactaaccctgccggaccaaaagcgcttcttgctttccgacacggtcggtttcgtttctaaactgccgacccacctgatcgaagcctttaaatcaaccttagccgaagctgccagcgccgacctcttgatccaggtgatcgattactctgatccccaccacgaggaaatgatggcgacgaccgatgaaaccctgcgccaaattgggatcgaaaacatcccgatggtctacgtctttaacaaggccgacaagaccgaggtgtccttcccgaccatggagggtgaagaccgggtcatcgtttcggctaagcaggacagttccatcgacctgatcgtcaaggtcatccgccagcacctctttaaggactaccaggaggccaccctgttggtgccgtttgccgacggccacgtggtttcctacctcaatgaacacaccaacatcttggacaccgactacctaccggacggtaccaagctacggttagagatcgcccctgaggacctgcaccggttccaaaagtacttgctgacggaataaaggaagtgggaaataaccttctcgacagaccgtatgactaagctagggagaaggttggtgccttggcaccgttcttcgcccgtacttaggcactaggtctgtggtcattttccacgttatcagtgagtgtgacccagccattaagcaggtcgttagggataatattaaatataaccagggccgggagagcacgtctcccggcctttttaggaagtgttaacatgcaaattgttcaagccaccctctatcgcctttctttgcccctcaaacaccccttcacgactagctttgggcagctgggcgccaagcagtgtttgatcttagaactagttgacgagttaggccaccacggctttggcgagggggccgcctttgaggttcccttttacaccccggaattcttagacggcgactgggccctgttagagcgccaactcctcccccgcctcttaaagacgcccctggcccatcccgatgatggtgacgccctgttttcctacgtccgccacaacgaaatggcccgcgccgccatcaactgcgccctgtgggacctctttgcccagcgaaccggccagtctctagcccaggcgatcggcggtaccaagacccaagtcgaggccggcgtcagcatcggcatccaaccctccccagcggaactggtgactaaggtgggcgactacctggcggccggctaccgacggatcaagatgaagatccagccggggcatgactacgattacctgcgggcggttagggaggcctacccgaacgcgatgctgatggccgacgccaattcggcctaccggctcagcgacctccccctgctaaaacggcttgacgacctccacttaaccatgatcgagcaacccttaggcgccgatgacctaatcgaacacgccgccctccaagccgaactggcgaccgccctgtgcctagacgagagtatcaactccttagcagacgccgccacgatggctaagctgggcagcggccggatcattaacgttaaggtcgcccgggtgggaggactgagcgccgccaaacggatccaggactttgccagccagcacggcttagaatgctggtgcgggggaatgttagccaccgggatcgggcgggcctttgacctggccgttgccaccctccccggcttcaccctccctaacgacatttcagccgccgcacgctactttgaccaagacatcaccaccccgccggttaccctaaatggggccatgattgacgtgccaacccaagttgggctgggatttgaagtcgaccaggcagccctggccaagttcaccacccaaaccgttcaagttaaccgataacgctaaaaggcgcccgcccgttcgtagttcgaactaggctggcgcctttttagatctgcaattactttccggccccaccttcgttatcggcctccccgctcgaccacaccttcgtggcgtagaccgagttgaacaggagggccgcttgcagggccacctgcgataagttggcccccaaggaaccaatgtgggtcgccccagtcatcacttggacggctaagatcccccagtagatgatgttcgccaagttgacaacgatccatagtgaccaattttcctcaaacttgaggatgtaaagaatttgggcgatgaaggaaacgacgaagttaatcgaatcaaagtagggtagctggccgtgaacggtcgctaagatccaccaaccgatcgcccaggccacaaaggcaccgccaaagattaagccccgggtgcggctcgagaagcgcttggtggcttcgtcgtggccccacatgaaccagccgattggttgtgagataacgtagaagatgtccatggcaaaggaaccgtaggcgtgcgagatccaagcgacgtaggtcatcgctaggcactgaatcaccccgaagataaaggaaatcttgcgccccttcattccgtagaccaaacacaaggtcccaaagacccccgacaccatcccgatcacgctatccggtgcgattagataaacgagcacctgtagggcgatgaggacgctaacgtagataacctcaaacttcttccagttggtaaagagctggttataccaccagccgtggcgtgcgttttccatggtttccctcctcaaaataaccataatgatattaaaaccatcataagcggggtgccggagggtgacaagccccaattaaaaatgggattggaaaattttccaatcccataacgtgctccccaaccacgggcctagtgtctaagcaggatgaagaacgccacgttccgtgacaaccttcatcccagcttagccaaacggcccgtcgaggaggttggtccgcactcactaagataacgtgctcctcagccgcaggcctagtgtctaagtacgggcaaagaacggtgctggcgcaccaaccatttgccctagcttagcccacggcctgctttaatggctgagtcgcacttcctattgctcatcaatcaccacgtcttcgttgaccttggcggcctcctttaggtctggcccgtcaatccgcgaggcaatcgcccagcggtaaacgattaaggacaagatcgtgatcaccacgaagtcatacgggtactcgatcaaaccggtcccgccaaagcccttgctcccgacgtaggaaagcaccgacagggcgaccaggtaaaagagcatccataaggaccccttcagttgcgtccggagcggcacgtggtcgtatttaacttggtagtaggcgtaaattggtaaccccaaaacaaccacgaagatcacttcgacggtcgttggccacatcgcccagtaaatgaccatgctggtcaagacaaaggataagggggcgacccaagacaaggccttggagttgaagggccgggtgaagttaggccgcatcttgcgcagggaaacggcggttaccggcccggtggcgtaggccacgaaggttgaaaccgaaacgaccgtcgccagcttggaccagtcgcggaagaagaagaccagcaccatcgccaagaccaagtcggccaccatggcaaagcgcggaatcatgtagcggcggtttaaacgtcccagccaggctgggatgttgccgttgcgcgtcatcgccgctaacgtccgcgccgaggtggccacgaaggtcaccccggtcccaaacggcgaaacgaaggcgtccatgtacaagaggattgacagccaggtcaatcctaacagaatcgccaagtcggcaaagggtgaggagaaattaatcccctgccagcccaccttcgccaaggtggttgggtcgaccgccccgatgaaggcgacctgcagggcgatgtaaatcaccgccgtaatcgtcagggagatccacaccccgcggaagatatttttttgcgggttcaccatttcaccggccatgttgatgacggtttggaaggcgtcgtaagagaggatgatcccagaaacggtcaccgcctcaaagatcccgcgggtcccgtttggcatgaaggtcgcggtgctgtggccgaagttccccgggtgaaagccgaccacgatcaaggtcacgatcgtcaaggtcgggatgactaatttaaagaccccgactaaggaggtaaagcgggtcaacaccttgaccgaccagaagttgattagggtaaagaccagcatgaagacgtacacgaccaagagcccctcggtcgtgattgccccatcgtgcataaagttggccgtccagttggcccacttccacggccaaccagccatgtattggacacaggcgactgcttcgatcgggatcagggtgatcaaagagacccagttggcccaggcagctaagaaccccagtaagggcccgtggctgtactgagcaaagcggctcattcccccgctttcgggaaacatggtccccaattcaacgtagttaaaggcgatcaggatcatgatcgccgcccctattacccaggaaataatggcggccggaccagcaaccttggcggccgtccccgaaccaaacagccagccagagccgatcagagacgatagcgccagcatcaccccggaaaagaggctaatcttattttttggcatgattactccattcaaatgattagtgatagagaatagtatagcacagctcagcgcaagcaaacaaaaagcaaaaggtgtgatggaattagcgatttatcaaaaaggaaagcgaattgtggttccattaccagtctaaaaaaacgtcctcagcatcaaaagtgaggacgtttttttagatttctttttctaaaatcggacaaatacgatcttgttttcctaaaggaaaatgtttgatcccgatttttttaaatccatgacgttcataaaaacgaatacctgcatgatttttttcataaacagccaaacgtaaataacgtttttgtttcgttttagcataacgattcgcttcatcgagtaaccgttgccctaaccctttgttttgataatctttgagcagatagatccgttgaatctctatagcatctttttcatcattgactttcatataaccaatgagtatttgatgatccttaataccaataaatttactggttgactgtgccaattctactgccaatatttcagttgtcaattgtgtctgtaaatatccttgcatatcaagtggatctgcgccatcgataaacgattcataaaaactgacaacacttacaacttgtaaagcatctagatcatcataatctaaatacgctagtgtgatttgattgttcatctaacttctccttttgacataatatactataaatcacccgtggtgctagttaattttaatatcctaaagaatatctcaaagttccttcaaaacgtcgttgtgctcgacttaatagaacactgtaagccagtaatatgctttcaaatctactctctagccctttaataaatattggccggaaatcccgtgactttagtcatgggatggataggcttctacttacgtcctttagggcgttttttatttcattgtacttttgattattgatatattgctcaacgacctccttgctcatattccctaaagtactcatgtaatagctaggggaccagaggtggccaccccaatactgcgactggcggatttccgggtgtcgcttgaggaaaatgaaggcactgcgtcctttgagggctttgatagcgctagttggtgctttactaggtggaaaactaatcaacacatggacgtggtcaggcattacttccatgtgctcaatcacgatttcgttatctgccgcaaccgttgtaaggatttctttcatttcattcactaacgcttcactagtaaaagttggattacgatacttggttacccaaatcaaatggtagtgaaagttataaatataacgccgtgtataaatggtatcttcgattttgtcctttgacatgattgccacgctccttaattattattatcattgacatatggtataataacactatatcagtgaaggaggtgaaaataaatgaagtcaatggcgcagatgaaatatcattacggactcaaggtgcggatttatccaagcgacaggcaaaagaaaattatcaagatcaatagtgatgctagtcgattcatctataacgaaatggtcgctattaacaaggaactttggcggctaaaacaggttaaactcccgattgataccactcagaaccggattgagcaactggagcttcgccaaagcgctaaacaaatgtctaatcatttccagttcttagaagataaaaggatcgatagcttgactaaagccaatgccattcaaaactaccataaagcttggaatgcttttcgcaaagttcataccgcaggtgtgcctaagtttcaccggaaaagttacgtctggcgttatcaaactaactgccagtatttgaaacagaaggcagcatacttaactaacggaactgtacattttgaagatagtaagcatgtgatagtgcctaaattaggtcggctccgtgttaaaggttcccatcaacgagtcttagctcgcagtgctgaaacccgtattggaacggtaaccatcgtaaaggacgctagcggtcgtttctttctctcaatgcagttagcgtcggatactccctttgtcaattggccgcaaaatacaggcaagcagattgggattgatcttaatactgaaaacttcttaactactagtaatggcgatactgtggctaatccacgctattaccgcataattaagggtcgcttagccaaagcacagcgcatcttatcgcgacgggctcgtcgggccaaacaagaacatcgaccattacggactagtaagaactaccaaaagcaacgcttgttggtggctaaattacacgcccaagtctttgaacgtcgacgtgactttctccacaatgtctcgactacactaatcaagaaccacgatttcgtagccgcagaggaattgcggagtaaaaatatgctgaagaatcatgctttagcgatgagtattgcggacgtaggttggcggactttcttaggaatgttggcttataaagcagaactctaccatcgccaattccttacggtgaatcctaagaacactacgcaggcttgccatgaatgtggttttgtgatgggcacagcagggaccgaaaaactcacacttgcagaccgagaatggacatgcccaaagtgccatgctcaccacgttcgtgaccataacgctgcgcagaatattctaactaaaggaattattaaattagcctaatttggctcgtccctatggcaacctggggacgctaaaggcattggtaattgccatgtaagacgaaacggttcgtagaactgttcgcagtggtgtatctatgcaaattgtgattcaaacactcatcagaagggtgcttgctcacaagccactgactttagtcagtggtggttgaccagaacgtgagttgaaattttgacaacctaatttttctttgttttccaagtaagctgtggtctagtttttctgatttatccatgtttttacgtggcggaacggatatagtaatgcccttaagggcaagcttttcatggattttatggctaatatatcctttgtcccctaggatattgggaagattcgcttcttccgataaagtctctaacactttcacgtcatggacacctggattagtgattgagtaagtaatcggaaagccagtcttagtaacgatcatatgaattttaagaccggcgaattgtcaaactaagtgcaacggtttgtcaaaaaatacttcatatggggtttcatagtttaacactttgcgaggacgttgatttaactgcttttggcagtgttcaacgtcctgttctgtataattatcaatatctgttcgcttgggaaaatattcccggattaatccatttgtattctcatttgttccacgctgttcaggcgaatatggatcgggccaatagacagtaatacctaacctttcgctgatttcatcaagatgaagaaattcggtcccatgatctggtgtaatagaatgaacaaattctttaggaatggcccctaacagttcaactaagcctttatttatctcctgcgagtccttttgcataacctttttgataagcgtaagccgactaagccgatcgacaaccgttaaaaggatggagtgacccgttcgaccaatcacagtatcaatttcccagtcacctatacgttgacgctggttgataaaaccagggcgctcatggatcgagatatagtcggtctgtacttctcgatgtcgtctagtattctttgaatgccgggtccgatgtttatgtctgagatggcgctgaataccggtatcaccacgtgaggagtacttttcacctaaattgtgttgatagatatgacggtaaattgtgttgtagctaacacaccattgatgttccttattaaagcgagcggtaatctgctctggtgaccagtgcagatctaagatgtaatgaacaatttgacggcgtaattgtggatggctgtctaatagccgcttcttgtgacaattctgccgcttttgatgatagtcattatctgctttgcttggggaataattacctgcacaacgttttaactcccgtgaaatagtgcttggatttcgccccagccgtaacgcgacagcccggatagataaccccttagctcgtaaaaacataagtatttcacgttcttttatagtaagatgtttatagctcataccggatacctcgaattgtttaatttggtcgttaaacatattctacccggtatgggtttatttttttactttgtgttgcatttcaattgtaaattcgccccataaaaataagatttttttgttgagttatagccaactttgactatttgattcaatagttttgcttgtctatttctaactggtttacataatggactaggaaaactatctataattccgactagttcacctttggtgagcttcttgatgaaaaagtatcgaataatcttgatagtgtaagctaagtttgaacttaagcgagtgaatcgactcctactaggaaagtcaccattaggaaataagacggaacaaaccgctctatacgtggctctttggctagtatagccattaattatgccccatataacacaagcaataatcactgtatcgcgttgcttcagttaatcagtatttcttcggtttttaatcttatctggtacacaattgtggtatatgttagaaatagttctcataatttccttgaatgttataaaagtatctgtataatgttcattatattttgatgaacgcatatgtagtcctcatttcttgggagttttgagactactatatgcgttttttttgttgatttaccaacatgtttagacattttcctctaggaaaaaattaactagcaccacgggtaaacacctttattttttacgtcaagataacaatttggtaacgttaaaatttcacacaaaagaataagcgccgggagtgtcccgacgcttattaatatttattatctaattatcagacgctttactgacggtccttgaggtgcattccgtcatcgtctgcttccgggccgaggagctcttgattattgtcaagctcggacttgccggcgtagtgatggcgttgtaggtagatcatcgaaacgagcaataatattacaaaaacgatcgtgatcgcaagtaagacgctgttgcaaaaggccacgtaatgtgctcccaggccgccgctaatcccgttgcgcagtcccaggatcgagtaggtcatcggcaggtaccagtggatgacgttataaaacttcatcgtcacctgcatcgggaaggtcccccccgagcccccgagttggagcatcaagaggaccatcgccacgaaccggcccgggttatcgaaggtcatcgataagaacatgaccacggccatcgaggcccagccaaacaggatcagggtccagaaaaaggacggcacgtgtaggacttggaggcccaacagcatcataatgccgccttccgccagagccatcacggtgacgctggtcatcccgacggctaacttgctggcccaccaggcgctggctttacgaccaaacaaggcgacccggcgaatcgggtagacgaagttaaagatcaaggtccccacgtatagagccaccgacaagacgtacggcgctagggcgtggccgtagtttggtacgtagctgtaattggtgtgcttaacggtggtcggggccgcaaacatcttggcggccttcttgcttggttgcaccgcattaaccttttcggcgccactaattaacttatcagctagctcaccggccccggcgtttaacttcgccgttccggccaccagggctggcgaattatcgaccaacttctgggtgccgctagccagggcgctcaccccactgaccaagcttggtactttggcgttgagttgaatcagggcggtggctaattggttggccccactaaccagggccgctgaattaacggttaactgaccagtcccggcgttagcttggttaaccccggccgtgtactggctaaccccgctttggagttggttggccccgctagtcagactagctgagttggcactcaattgactagcaccgttagcggccgtgtccaccccggccgtgtattggttaatcccagcttgggccgtgctcatcccgctttgcaggctggccgccccgctggccaagctgttagtcgcctgcttgagggccgccagttggcttggcatggcagacaacgccccttggtagccctgcagggtcgtcaacagttggttggcctgattcaaagttgtttgggcgccgctcaaggtcgtctgtaagctagccaggttgttaagctggctttgcaggtcgctcaggctggtgctcaagctgttgacctgacttaaagccgtccccaagccctggatggtcgtcacgttggactgggccttttggacaatcgtatctagctgggccttggtggtggcgtcggtggtcgacttggccagggcgtgagccgacagggcgatcgcggtgtcgttttggtacacctcgctcagggagctagccgccgagctgaccccacttaaggcactcggcgccgtttttaactggttcgcttcggtgctgaccgcggaaagggcactctgggcttgggttaagccggactgaaggctggccaggctactcttcatttggctggcctggttcatggcggacatgatcccggtgaagtccaggctgcccagcgagctgttaacggtggcgtttaactggctcgccccgttgcttaactgactagccccctggttcaggctggccgccccgctgcgcaggctggccgagttgttctttaaggtcgtcaggccactgccgagttggtccaccccgctggtgtactggttgaccccgctggccagggtggccgtccccgcgtttaaggccgccgaattggcgctcaacttggttaaaccggccgctaacaggcccaccccgctggtgtattggttaaccccgctggctaaggtcgtacttcccgaagccaattgactggcgccactagctaggggcgtcacggccgcttgtagggtttggaccccgttgttaaccgttgaaaccccggcgacaaactggttggtccctgaatttaaggtcaccatcccggtgctaatctgcttagccccgctggcggcctgattaaagccggtccccacctgtttgactaacttgatcatcgtggtggcgtaggactgggtcacctgggcgcggatcttttggttgagcttggtcatcgccatttcgctaatgacttggccgatgtagttcaaggagccgttagtttcgtacttcagctccattttcttagggctctgatccaagacggtggcggcgtttttagagaagtcctttggaatcgtcaccaccgtgtagtacttacggtgggctagcccctccttagccgtttgcttagacacaatctcccacttgagctgcttattcttccttaattcctgaaccagctgggcgccgacctttagggtttgcccctggtacttaacggcgcgatcctcgttaaccacggcgaccggtaagttttgggtgctcccatacgggtcccagaccgacttcaagaagaaaatgctgtacaagaagggaataaaacaaatcacgataaatgataacaacaggaggcgattacgccgaatatgccgaaattcagccttgatcatttcccacattgatcttttcctctctctcaattgattttggtttgaaactattggaccagggcgtgcaccgaccgcttgatgaaggtgacgacctctgctttcgggacgtggtagttgttttcttgccaccagtaaaaggcgcccatgattgccccgctcaagacgtaggccagcatttccgggttctcctccttcttgagagcgaccacgatcgtattttggctcggcgtctggcgccgggccagtaagatctcggcaatcatccggaccaactcggccgaaaaggaactccgcatccccccgttggccaggttggaaaacatagcccggttggcttcgatttggctgactaaggcttcgatcaggtcgtcttcggtggcggtttggtcaacaatccgctccacccaggcccctaaggcttgctcgagtaggtcgtacttatcatgaaagtagcggtaaaagctgctccggtgcaggagggcctcgtcgcaaatctgatcgacggtgatcctttcaaatgaggtggtcaacagtagattcatcaaggcgacttcaaagtcccgcacggttcggttggctttcatttcccggtcctccattccaaactaacaccccacattatagagtgggacaccgatctctaacaggttaattttaggatttttgttttattataagacaaatgtagcaaattgttccaaagttagttttagtaaagttttacgaaaaacagccgcaggcgcccttagctatgctacaatagggaacgtggaaaacgcttactaattcatcaaggagatgtttttgatatgcaaattacaacttcaacctttggtacttggcagggccaagacgtcattaagtacacgatagaaaacgataacggcgttcaagttagcgtcttgaacctggccgctttactgcaggcctacgccgttccaacgaaggacgacggccacaagaacctggtgctgtcctccgacacggtggccggcttcatggacaacggtctgtgcttaaacaagtcgattggccgggtggctaaccgaatcggcggcggccacttctttatcgatggcaaagagtaccaagttgaacaaaatgaggggaacaacaacatccacgggggttcccacgggtttaaggaccaaatttgggacgccgtgaccgaccaagtcgacgaccaacttcaagtgatcttcaccaagaccttcaccgaggaaatggacaccttcccggggaccgaaaacgccaggatcgtctacaccctccacaaggacaacagtttgacgatcgacttcttcgcttctagcgaccaaccaaccctgtttaacccgaccaaccacacctactggaacatcagcgacgacgacacgatcgaaaacatcaagctgaccttaaactccaagcaccacctggccgtggacgaaggtaagatcccgaccggcgaaaagctggttaacgagggcaccccgtacgacttcgccactgctacccggatgggcgacgccttggcccaaatgaaggcccaaaccgctgagggcggctttgacgactacttcgtggtggaaccaagcaataccctggaccacatgccggtcgccatcatgaacgacccggctaccgggcgtgaagttaagatctactccgaccgtaacgccatgatcatgtacacggccaacggcttggacaatgacgtcaaggacctcgaccaccccgctcaaccgtggatggccatggccctggaaggtcaaaccctccccgacgccattaacaacccggcctttggcgacacggtcctgcgcccgggtaagccgcaacactaccaactgcagtacgtggtgaagtactaaggtggaagtgcgaccaaccttctcgacgggccgtatgactaagcttgggtgaaggttgatgcggtacgcatcgttcttcagcctgcttaggcactaggcacgtggttggaagcacgttatggaagtgcggaccagccattggcaggccgtgggctaagctagggcaaatggttggcgccccaggcggcgttctttgcccgtacttagccacccaacaaaaaaagcaccccgcggggtgctttttttgattggttaatggcggcgccgggcccgttcccgggcccccagcggctgggttggtgcgcccgtcgtggttgaactatcagtttgaccctggcggtcccggtaggccacttgggcgaccaggccaaagtcgccatcggtcaggatcgttgaaccccgccgacccgggatcttgcgtggccccccggtgacgtagaggctggccaagtagaggtcaaactggtcgtgggcggtgtgaacgtcggtcaagccgacccgcttgatgtggccgaccggccgtttttccatctggtttagccccatgtaaatctccaggcggtggcccaaaggatcgtaaaccagttcaaagtaaggtggctgctggccaacgtttaaggcgtcgaccggctggccggtttcttggtactgggtgataatcccgtcgtcgtccaggccgttgtagtcggcgagtaggaccccttctgcgactaggtggtcgaccaccttgcggaggttttcttgctcgcgggaatcgatttcgacctcggcttggatcacgtcttcaccagtgaataacccgttggacgcccccattgcttgcttttgcagggcggccagcttttcgagccgctgacgctccttttcttcgggggtctcacgcgtcgtcccggtcaacttagatagccaaggcgacaggaagtcaaaacgcgaggtttttcccaggaaataataaacggcgttcaagtagaggtagtaagttacccccaccacggccaagaagtacaaaaagccccgcagccaggactggttctttaggagcatgaaggtgacgtagatcaggtacaggtcaccaaaaaaggccaggcccacgtaaatccggtttttaatcttgacgctgaggttaaagtaacccagcgacccattgatcatgtccagtaatgaaaacatggcgtccctccttagttagtggttgtcgtggtggttcccgccgtgttattggtggtcgtccccgttgtggtgttattgttcgtggtgttgttggttgacgacgaagaattgggggtgttggtggttcccgtgctcctagtggacgagctcgtggtgctcccgccgtcattagccgtcgtgtcgttattattggtggtcgtgttgttagtcgtgttggtcttgttagccgacgaagaatcggtcgtgttccccggcgtttgactactatccttatcactgccgtcatcgctcggcttgcttgcgctattggctggcccggagttcgttgacgtcgagcgggaacccgaagaaactaccaccgctccgttattggtgttggtcgtcttgttgaccaccacgttggtcgcccccaaggcgaggaccaccgacaccagggcaaacggtgtaataaatggtggtgtgtttaatggcatttcgttctcatccccctttttggcattacaaattagcattacaaattatacactagccggcgattcgtaacgtttaaaagattcttatattcccgtgaatttattttgacccggcttccttagcgcactgggcgcaaagaccgtagagctcaaaggagtggccggtgatttggacccccggcaactgttgttcataaaaattggtcggccacttaggcatctgaatctcttggacccggccgcacttttgacagataaagtggtggtggtgctggtgggccccgtcctcacaagaaaacttcaccgccttgcagttgctccgctgggtgatttccaccaggccaatttcctcaaattcctcgaggttgcggtagatcgtgttgtgggagatcccggggtacatgtcccgcatcaagcggtccaccattgtgatgtctaggtagtggtccggctggtgaaccagcaaatcaatcagggagcggcgttgcttggttaaacgcaactggtgatttttgatgatcgtttcggcttgggtaatgagtttatccacggttatcccaccttttttagtaatgattacgtttttgaaactagcttgattgtaccaccccgggggcgacctgggcgactaatgcgtccaggctttgcgtggtctgggcccagtcgtcattgacgatcacgtgggcaatccccttcaagtagtccggtagcgattgatcgcggcggtactcgttagacgtcaggcgtgacttcacggcatccaactggtcgccccgctccttgattcgcttggctagggtttgcggattgctaacggtcaaaaagatcaccaccgcttggtcccccagggcctggtggtaggtcaaagcgccggcggtatccaagacgatcacgtcggccgggtgcttggcccagccggcctctagcccctcgtaagaagagccgtagaggtggccatcgtactcgacccgttccagcaagtggcggtccttaattgacgtggggctttcaaagtagtaatcgactccatcaacttcacccggccgcggggcacgggtggtgtgggtgatcaccttagccatttggtaggtatcctttaggtacttggccacggttgtcttgccgctcccggccgccccggtgatcacaaagacgggcttagttgttcccgccattatgcttcctccaggtgggcgttgacctggtcaagcaggtcctttaagttatcgtaggtcagcttttgccgcgccgtttggtaatcaaaccagccggcgtttttaatttcttcggcctgcaagtggaggccggccgcttgatcaaagtcggctaagtacagggtcatctgcttgcggttgccgttgggcaggtcgtattcggtgtaaaccgaaaagctggtgtcgacggcgacttggaggctgatttcctccttaatttcgcgggttgccgtttcaactaggctttcgcccgcttccacgtgtcccttgggaaaaccccagaagttgcccttgttcatgctttgtaagagaaggtactcgattcctgcttggccatgccggtaaacgacggcgccggcggttacttcaattgccacaaaactcacctcattaaaatttaattgacttttaataatatgttctctatcatgtttaagtagactttatcataaattatagcaaaggtggttagcgattatgagtctgaagataatgcgaagggagagccttcaaacttatttgggggccgaccaaaagttcgtgaagtcactgactgccttcgacctgatgaccctcgggatcggggcagtgatcgggaccgggatctttatccttcccggcacggtagcagccaatgatgccgggccgggggtgaccctgtcctttttaatggccgccatcgtctgtgcgttggcagccatgtgttacgccgaattctcctcggcccttccggttgccgggagtgcctactcttacggtaacgttgtgtttggggagttaatcggttggattttgggctgggccttgattttggaatacatgttggcggtcgcctcggtatcaaccgggtgggcggcctactttaattccctactcgcctcgtttgggattaacatcccgaccgccctttctgggccctttgatccggcccacggtacctacatcaacatcgtcgccgtggccatcgtcttgatcgtcaccctgatcttatcgcgggggatgcggtcttcgatgcggatcaacaacgtcgccgtgatcatcaagatcttgattatcctggtcttcatcggggtcgggttgttcttcatcaagccggccaactaccaccccttcttaccatttaagatgggtggggtgatgcacggggcgacgaccgtcttcttcgccttcctgggctttgacgccatttcttcctcggccgccgaagttaagaaccctaagaagaacatgccactggggatcatcggcaccttggtaatcgccacgatcctttacatgggggtctccgtggtcttaaccgggatggttccgtacaccaagttagacgttgccaacccggtcgcctttgccttaaaggccgttaaccagggttggatcgccgacctcttatcgattggggccttggtcgggatgttcaccatgatggtgacgatgacctactcctcctcacgactggtttactccatcgggcgtgacgggctcttgccaaagttcttgagcaagcttgatgaacacagttccacgccacaagccgccctttggatcgtggccgtcatcatcgccgccatggggggactggtttccttagaccaactgactagcttggttaacattgggaccctgctggccttcaccttcgtttcctttgggatcatcccgctgcgcaagcgcaaggacatcgggaacaaggggggcttccaagtgccgtggttcccagtcttaccaatcctgtctgggatcgcctgcttggttatgatcgccctcttgtcggttcaaaccttcattggcgccggcatctggtttgtgattgggattattctttactttagctacggttaccgccacagcaagttggcgcatggttaaatagttaagtgctccccatagtagctagataatactaacgaacacagcaagagagcctgagaggaaacgcgattttctctcaggctcttgttgtatcttcagaagattagacagataacgtgctccccaaccgcaggcctagtggctaagtccgggcaaagaacaccacctaggcggcaacccttgccctagcttagtcatacggcctgtcaaggaggttggtcgcacttcctaagataacgtgctccccaaccgcaagcctagtggctaagtccggccacagaacaccgcgttccgcgataacctgtgtcctatccttagcccacggcctgcttgataggttgggtcgcacttccatattacgcaaatctaaacatttgccctgtcttgtttttgctcctcacccgctacacagctaacttgccacttctcgctgttgattgcgttataatgatacaaattgccaattttgaaagggtgttcattgtgaaagtcaaccaattctcactgattcaaaccgacgacgccacccgccgtcacgaattaaaggccctccacctgctaatggacggcgacgaaaacctctcggccagccagctcctgttggccctccttttgcgaacccacctggaaaccaccagtgacgccggccgggccgcctggttaaagagcctcctggccacgccaaccaccaacgcctacgactggtttaaagaagacgagcaaccaaccgacgccgtgttctacctgctggccctccagctgctcgactttgaagtcgccgtcgacttcccgctcgaataccccctgctggggatcaagcgtagcaaccttccccaccactaccacgaggaatgggaccaagcagcggtgatcgattccttctacctgctcttgttgacccggaccaaaaacgggatcagcctgctcgacaagctgaccagccaggggatgctcacctggacctaccacctgccggccagccaaaagccgatctttttcaacggtaaaccagtcgcctcctttaacccccaccgcttcatccacgaggtcgtttacgtccaaaccgacctcgacaccgacttcgatggggaggccgacctagttaaggccgaggtaatccgcccggccgattccaaccaggggctcaaggtcccggttctctttaccgcgagtccgtacaaccagggcaccaacgacgagtggggcgaaaagatcacccacgacgttaacgtgcccctcacccacaaggatcctgacgccgacagcccggccgaagcaaccttcccgactcccgcccagcaccgcgacatccagggagtcgggccggcgagcgaaagatttgcggccaccccgtcatacaccttaaacgactacctggccacccgtggctacgccgtcgtttactcggccggaatcgggaccaaggactccgacggcctgcagacctgtggctcgccggaacaaaccgaggcgatgaaggcggtcgtcgagtggcttcacggcgaccgggtggcctttagcgaccgaaccagcaaccagagcgtggtcgccgactggtccaacggacacgtggcgatgaccgggcgttcctacctgggaaccttggcgacggcggtcgccaccaccggggtcgcggggctcgatgcgatcatttcagaagccgccatctcctcttggtacgactactaccgcgagggcggcctggtggtggccccgggcggcttccagggcgaagacgccgacgtcttagcggccgaaaccttcagccgcaccaagtccgccgccgactaccaacacatcgaaagcaccaaccaaaagtacctccagcaaatgaccgccgcccaagaccgggcaagtggtaactacaacgacttttgggcccggcgcaattaccacccccacttctccggcattaaggcggccgtgatgatggtccacggcctaaacgacaccaacgtcaagccggtccacgttaaggccttagacgactacttaaaggcggccgaccacccggcccacctgatccttcaccagggtcaacacatctacatcaacgcctttgcctccctggactttagcgaaatggttaacctgtggctggccgataagctgtggggcgtcaaaaacgacgccgatcaagtcttaccgcgggtgctcttcgaagacaaccgccaagaagacaactggcaagtcgctcaggcatgggacggccggatgaactttacctaccacgtggccgaccaccaactggtgaagggcgctgctacttcagccagccccatcacctttaacgaccaccaagcagacgccacctaccaagactggtgcgcccacccggccaagtggcaaaccgccctgttaaacgacgacggccggttttcggcccactttgccaccgaggtaatggccggcgacctggttttacgcggtaccccgcagctgaccgttgacgtggccaccaacctcgaccacggcctcttatcggcgtacctagttgaccgcgggaccgcccggcgcttgaccaagaacccggtcctgttgggcaaaaacgccattccgctgggctaccaatggaagtacgatgacctgcgcgagttcaagttggaaaaggagccgagcgactaccacgtcatctcctacggccaccttaacctgcaaaaccgctacagcctcgccaaaccggacgactaccaaccaaaccaaaccgtcaccctaaccctgcccttacagccggtctaccaccacttagaggacggccaccagctggagttaatcctctttgccaccgactacttgatgacggtgcggggcaacgaaaaggccacctacacgatcgacccggccacggtcgaactccggctcccggccgactttgcctagcgaccgttttcaactgcttaaaatttgcggtacaatggaaaccgttagttgatgacgcaaagagaatgggagttgaaaattttgaaacaaggcacaacgattttgacgcttgataacggctaccacctgtggaccaacacccaaggggaaggtaccatccacctcttggccctgcacggtggccccggtggtaaccacgaatactgggaagacacggcggcccaactgcaaaagcagggcttaaacgtccaggtccacatgtacgaccaactgggctccctgtactccgaccaaccggactaccaaaacccggcgatcgccgacaagtacttgacctacgaatacttcttggatgaagtcgaagaagtccgccaaaagctaggcatcgacaacttctacttgatcggccaaagctggggtgggctcttagtccaagagtacgcggttaagtacggcgaccacttgaagggagccatcatctcctccatggttgacgaaatcgacgaatacgttgcccacgttaaccaatgccgcgaagaagtcctgccggccgaagaagtcgtcttcatgaagaagtgcgaagaaaacaacgactacgacaacgaccgctaccaacaagacgtccaggtcttaaacgaaaacttcgttgaccgtaagcaaccgtcccgcctgtaccacgtcaaggatttgggcggtaccgccgtttataacgccttccaaggggacaacgaattcgtcattaccggtaagctcaaggactggcacttccgcgaccaattaccaaagatcaccgtgccaaccctgttaacctttggggaacacgaaacgatgccactgcaaacggccgaaacgatggccagcctgattccaaactccaagctggtcaccacgccaaacggtggccaccaccacatgatcgacaacccggatgtctactacaagcacctggccgacttcattcgccaggtcgaagcgggcacctttaacaagtaaacaccatttgggggaacagcaatgaaaaacttcatcttcgacgttgacggcaccctgatcaacacctacgaaatgtacatgccggccatgattgacgtcttggccaagtacggttacacctactcgccagaagaggccgaacgcatgaagcacgacctctttggaatcaccggtaaggacgccctggtcatctcccagatcccggaagaccagcacgaggcaattttagccgactggttcaagctctcttacgaacgcgaggaccggacgacgatcttcccgggcgtagaagacacgctggccaagttagccaaccggccgggaacgtccctagccgtggcgacttctaagttaggcgccgaataccaagaacacatcgccgctaagtttgcctttgccaagaacttcaagacggcggtcacctttgatgacgtcaaacacggtaagccggccccggacatgatccaagttgccttaaagcgcctgggtaacaccgacttaagcgaagccgtttacgtcggtgacacggttaacgacctgctagccgcccacgccgccgggatcaagtttgccgccgctttgtacggctccggcgataaggataagctggccgacgccgacttcatgctgacttcccctgaacagttgttggatttataaaaagaagtgcgacccaaccataaagcaggccgtaggcaaaggataggacgggggttgacgccctggcgtcgttctccggccagacttagccactaggcctgcggttggggagcacgttatctctgtaacattcaaaaaggttgagagccgttacctgctcccagcctttttgttttcactaggttggggagcacttcccttttcatcacccccaaagtccggtaagatagaaggtacgaaactattgattaatttttcgtttgattagccgtgcattggggatatacgccggttaatcaaaccacgggaggatttaaaatgtacgattaccgccaggacttacaaaccgtcctgaacagctttgggagccaagcccccgagctaaccaacggaccagccgccttgcgcgcgctggcgaacctgattgaacaaacacccacgaaaactaccgcagacgctagtgctccggcaacagaaacggtcgccacgccaccggaggctaacgttaccccagttgaggaggaccagccagaagcgacgccggaaccagttaccgtgacgccggaaccagaggccaccccagccccatcgttaaaccaacccacgggtcaagacgaccttgaaccagtcaaatacagtggcgaacagttcagcgcccaccaaaccatcaaaaacctgatcctggattttgacggctgcctaaaccagctggtcaaagatcccctggccacggtgaactttgctccggtggaaaaacggctcaccgccctaattgacgacctgagcaaagaagaccaggaagccctggccggcgaactaggcctggccaagagccatttaaagcggctcaaaaaggtgaccgccagcctgcacggcgccatcaccaacttggtcaaggagcaggcaccaacggcggagccaacagacgcgccggaagttaaggaagccaccccagctaaaacggacaaccccgcagttaacgaggcgccggtaagcccagcgccagccaagcctgcctcaacggcgccagcgactcctttaccggccgtcaagtccgccccggcagaacccagctttgcggaactgtttgccgcttcagtcgccaaagaggaacgccaggcggctaagcaaccacgcttaaaggcccaccactacctcgtacggcggcaactgaatggggccatgctgatggacgccgatcaccaagatatcgaacacatcaccgaaccgcttgtccgccagtttggcattcaacacggtgacgaagtggtcgccacacccggccaccgcgacggtaccctactaatcaagaaggtggtggggcacgctaaggacgtgccggcttctaccattgccaccttcgggtacgggaaggtcgaaaagctgggtccgggccaactggtcgtccgccaaaacgttagcggcgctcccctcgtcatcaatggccaacagacgagttaccaagtggaaacgcttagtatcgaacggatggagatcaacgaaggctccatcgttgaactagcctggtacacggggcaacccgccgacgttaacccctttgaaccccacatccgttggcactacccggtcgaagctagtgccaagccaacgatcgccagtcaaatccggcaggcaaaaccggcgccaaaacaagttgccaagcccaaaccagcggccaagccgacttacgacctggacctgaaggggaaaaaggtcgccatcatcgtggggcgcgggcaaaaccacgtcctctttgaacggatcgtcaagcgttacaacggtaagccacggattgtggatagctttattcccaaaaagcgcctgatggaacgccaacttaagggcgtcgacctgattgtgatgatcgccgcctacagcaagcacgccacctcctggtcggccgccgagattgccaagaagtacgacctgccgtttaccaatacctcctcattttccgtccagtcctttgaacgggccctctaccgggcggcgatggggatgcgggcctacgaaccgggtggtaccgatcaggcagactaccggttaagtaaataagaagtacgacccaacctcctcgacaggctgtatgactaaggataggacgcaggttagcgcgtcagcgatgttctgcggccagacttaggtactaggcctgtggttgggagcacgttatctgtggaataggcaaaaatcaaattagggattgggaaggatttctcaaccccagtaacaaaaaagcaccccgtggggtgcttttttgtttatcggttgggtcacacttcctaaaaatcataatcctcatcggacatcgcctcggcgttgcccatcaagtagccggccccaacctgggagaagaagtcatggttggccgtctccgtcgagatcccgttcatcacgatcgggttaatgtcttcaatggcggcgtggttaaagatggcggcaaagcccatgttgttcatcgccttattggcgttgtagcggacgaactgtttgacatcctcgaccatctgaatgggagcgtaaacgacctcggtaaaggcgaactcgttttccaacaggtcagctaagaggtcatccatccaggcccggaagcgggtttgctcatccggggtcagttcggcaaaggcctgttggaacttgtaacccaggtaggtaccgtggaccgattcgtctctgatcaccaacttgatgacctctgaaaggttggccaacttgttgttaccccggtaccacagcggggtgaagaagttagaataatacaagatcccctccaaaaagaccgaagcgacctttttttctaggttattgccattttggtaaatctcgttaatgcgccgaaccttgtattgcatccgcggatcattattcatccagtgaaaggtatcgtcaatcgtcttttgatcgtttaaagtactcaggatcgtcccgtaactcttggcgtggatcgattccatcatcaagaaatcgttgatcacgccaacttccttgcgggtccgggcgtcctctcgcatcacgttgaccccctcttctgactgcagagtatcaagcaaggccaagcccccgacgaccttattgataacccccttttcactgtcggttagggttcgccaatcgccgcggtcgtttgaaaccggcacccgggtgtccagccagaactgggcggttgccttgtcccagacgtattcgtcaaattcgtcttcttcgacgttccaatttacgcttgtataagccattgtctcctcctaaaaatcgtaatcgtcatcgctcatgaactcggtggcgtcggcgtctttgatcgtttcaaccaccaccgtttcctgagcttgatttgccagttgatcgatttggtgggctaccgggccactttcggctggttgttcacccaggccaagggctactaagagcatccgccactggaagtcaaccaagtcgttagccgccccggcgtcttctaacagggcctcgttttgctggtgggcgagcttgattaacgattgggcacccttcgttagttgcgctaccagggcctcttgtttcgcaaagggcagctcagctatcccctggcggaatttgtaagccaggtagtcacgaaagatcaggttcccggtcaaaatatttttcagcatttggttagtttgggccagggccggctgggtcaggaccgcccagtcaaaaccggcacacaggaccgtgtcggcgatcaaaaagaggccgcggcgcattaggtcgtctccttcaattcccttcgttaagtcggtcagcgccgcttgaagaggtgcctgaccgtcagcccaagcgtaataagcagcggtggtttcttcatcggtcaagcggcggaagatcgtcgttaccgccttggtgtggaccgactccatgaaggtgatcaagtttaagaccgcctcttcctgttgggtccgccgtcccgcccgtaggctcggcgcccccagttcggactggaaggcgctcaagagggcccggccggctagggcgtgccccacttgggcttgttgctgcgccgtcagggcgtgccagctaggttgatcggcggtaatcggcacccgggtgtccaaccagaagttattggttaactttaaccaggtggcttggtcgacctggtcttcttgttcgtcccagttaattgccttgtagtacaagtaatccattgcttcctccttaaatcatgcaggattcacactcgttggcggtgtgaatttcgtcgtcggtggtaaaggtccgaatgtagtacagcgacttgatccccttggtccaggcatagttacgcaaccggtttaggtcgcgcgtcgtcatcttgggttggtcaggctttttccactcgtacaggccggtcggcaaggtcgagcgcataaacagggttaggctcatcccctggtcgacgtgtttttgggccacggcgtaggtgtcaatgatcttgcgctggtcgaggtcgtaagccggcgtgtaataaggcaaagtctcgttggaaaggtacggggcgggataaaagagtgccccgaccttgttttcctggcgctgttccaccagttgggtgatcggcgtcagcgaggctgaagtttcgttaacgtaagaaatcgagccattcggcgccaccgccagccggttacggtggtacaaaccatccgtttgcaccgcttcttttaaggcttgccagtcggccgtcgtcggcaggtgaacgcctgaaaaagcagcccggttcttttcaaacttaagggtgaagggcttagtcacgtagtcgtcaaagtaagaaccatcggcgtaacgcgagtctttaaaacccgcgaaggtctcgccccgttccttagcaatctggtggctggccagaagcgagtagtaattcagggctaagaagtaggcctcggtaaactcgagtgcctccggggagccgtactcaatctgccggcgggccagggcggtgtggaggcccatcgcccccaggccgatcgtgtggtagaggcggttgcccttagcaatgctagggacctcctcaatgttggtggtgtcagtgacgttggtcagcgcccgcactgccacttcaacggcacggccaaagtccggggcctgcagcatgttatcgatgttggtcgagcccaggttgcaggaaatatcggtgccgaccgtttcgtaagacaggtcggacgtcaaagtcgacggttcctggggctggaggatctcgctgcagaggttggacatgatgatcttaccggcgaccgggttgtcccgattggcgtgatcgatgtttaagatgtaggggtagcccgattcctgttggaggcgggaaatcttttgctccagctcgcgggctgaaatcgccgtcttcttgatccgcgggttggccaccaggcggtcgtactccttggtcaaatcaacgtaggaaaagggggtcttgagttcccgctcgacgtcgtaggggctaaataaatacattggggcgttggacttgagcaactggtagtacttgtctggcaccaccaggcccaaggagagggtcttgacccggatcttttcgtcggcattttcctttttggtctccaaaaaggccatgatgtcagggtgaaagacgtttaaataaaccaccccggcgccgttacgttgccccagctggttggaataagaaaaggcgtcctctaacaacttcatcaccggcaggaccccagacgaggcgttttcgatcttcttaatcgggtcaccagccgcccgcaagttcgacaagttgacgccaacgccgccaccaatccgggacagctggagagccgaattgagcgcccgaccaatcgatagcatcgagtcctggacgtcaatcaaaaagcacgacaccatctggccgcgccgcttcttaccggcgtttaaaaaggtgggcgtcgccggctggtagcgctgattaatcaactcgtcggtcaggtccttggctaactgttggtcgccgcgggccaagtagagggcgttggccaccacccggtcgttatagtcttccaggaatcgcttaccgtcgttggtcttcatcgcgtactgggtgtaaaacttgtaagcccccatgaagctcttaaagcggaagtggtgggcgcgcacccgggcctctaattggtcaatgaattccgccgggtactggtcgagaaccgccccgtccaagtagtcgtcagcgaccagctttgctcgccgttttgcggggctttgaaagcgaaccgtttggggaatgatgtggtctttaaagtaggcctttaaggcgtcctgatcgtaatggacggcaatcgagccattttccgggatgttaactagattgttgtagtaaaaataggattgtggatccgttcgttcttccgtcatgcttgttcctcctcaaaggcctgggaccgttccagtagcagttggccgatccgggtgatatcgttatcgctgccccgtagttcaaagtcggtcaggtagggaaaaccgaaccgcttggcgtactgcttagccgtcagggcgaactggcggttaaagttacggttgccgctgccgatgatcccgtaacaacggtggtagttgccttcgtaggcgaggtagtggcccagcgccggtgataaaatctcgctgtagccgttatcgcgaccgttgccaccgtttaaaaaggccggcaaaatcgtcacgaagggcgccgtcagtttttggcggtccggtttctcacggacgttaatcgaattcaccaccacccccaggtcttggtagtagtccgttaagcgccgcacaaaatctcgggtgttgccactcaacgagatatacaagatattgatttctttagccattcattgcactccaatcacaagatgttgtggttgtgattgtactagatttagttattaattaaaattagaataatttaatattcttcgtgatcaaccactttgttccccaccgctattcctgattaacggggcttcccctctgccctttcttgaccctcgtcacggatccgatgagaaaaatttaatttaacaccgaactcatcaccgttcagattgtcacttcgttaactaagtgatcgaccggtcgggattacgacttggttaaactttggttaccattacctggaaggtggtcaccgctcgtgagagtgtgctacaatccagctattagtgaaaatcaaaggaggatcagaatgcggtcttcattaaaacgcggcctactcgccgttgccctcgccttagtcgtggcgatcgggtttaccaacctcttgggtaaccaccgggtcgataccgccaacgaagccagctcttcaagtacatcagaaactagttcggtcatgcggacaccaattgactggcaaaagtcatcggaaacggtcgcctacccggacgtcaacgcccaccccgacctgtggatcaaggtttccaagaagaaacagcgggtttacctaatcgataacggcaagatcttatacacgatgtattgctcaaccgggaccggtaaaaacgatacgccaaccgggacttattacatccaggctgagcgggggacttacttttacagtcaacagagtggtgaaggggcccattactgggtttcctggttaaaccacggtgagtatctcttccactccgtcccaaccgatgaatccggtaattacaaactttctgaagcaaaacaactcggtaaaaaggctgcctcccacggttgcgtccgtctatccgtgccggacgccaagtggttctacgaaaacatcaaggaaggcaccaaggttgtgatcaccaatgattaaaaaactcgccaaagcctttggcctgcccagcttgctttacttactgggggtggggctttataacctctccacccaccagactggtctggccccgatttcttgggtgctaggctggcgggtgtctgggtcgggatgatcattctcttgattggctggccgttggtgctatattttaggcaaaaataaatccccagctaaggaagaactccttaactggggattttgacttctattacacagataacgtgttcccaaccacaggcctagtgcctaagtacgggcggagaacagtgcgtgccgcactaacccccgtcctagcttagtcatacaacctgtcgaggaggttggtcacactcacttcttaaacagtgccgccatcttagccgccagctccgggtcgaggctgtcggcgagggtggtttcttcttccttggcttcttctgcttggttggcgatcttttccttgacgaagtcgatcaccgcttgctctccgacttggattaggttaacgtccaagcggccgccggcggcatcggcgtggccaccaccgcggaagtgctgctcggcaaactgagctacgtcgaccttgccgttagaccgcagggaaacgctggtaggggcgacgaccattgccgcgtcgacctccgggttttcctccatcagccggtgggcaatctcggacttgtagtcgctagcgtagacgatcccccacttgtgaccggcgatttcttcgatcatcaggtcctttaagtgcccctttaagtagtggtctcggcggtcattcagcgtctggaccagcaggtcgttttgctggcggtactgctcccagccctgggcaaagacctgctcgacaaactcggccgagtgactgagcgggtagaaccagaagagctggtcgaactcgtcggcggccacccggacctcctggctcatgttcgggtcgttttgccagtcccaggtatcgtaggcccggatcagctcgatcaggtaggccaagtcgcggcgccggtcagcactaagctggtcaaaccgcggctgggtggtcaaccagtcccaagcgaggctagccgcgctcgggttaacgtccgcatctgcttgggtgaccacgttagcggcgtgcttctggcgggcctcggcctcgctttcgtggtggtcaaacaccagccagtgattggcgaagttggcgtttagttcctggaaagtgtgctcggagtccggcgtcatgtccatgatgtacacatcggtgaagctaccggcttccgggctgtgcaaccagcggtcaaagtactcgtcgatccggccggcaccgatgttatcaatgtcaaaggtcgtgtccggaaaaacggtctcctgaacggcttggagcaggtacggcgccccaaagccatccaagtcgttgtgggaaaaaatcttaattcgttcagtcatcgtggtcccccttgtataaggccattataccaaggattggcgtggctggttccttggcggttaaattcttgtttaacagtgcgcacccctattttttaaggcttaatttttcgacgtttaagaccttatccagccagccgttggtaaaggactgctcgtgggaaaccaaaattaaattgcccgggaaattttgcagggcccgcttgagcccctccttggtttcgtcgtcgaggtggttggtcggctcgtctaggatcaagaagttgctgggcgtcagctccaagagggccagtttgaccttggtctgttcccccccggacaagaggttcattggcttttgggcgttggcggcgttgatgccggccttggctaagcgctggcgaatcgtcttgggtaacatggtcgggaactggtcttggatcgtttgtaggggcgtcttggttgggtcatcccaaatcaggtcctggtcaaagtagctaatcttcgccgacggggagaaggtactggtccctgatagcgccgggatcttacccaaaatcgtcttgatcaaggttgacttaccgaccccgttaaagccggagaagagcagcttttcgcccccggtcatcgaaaaggtaaccggcgccaagagtggcttgccgtaaccagcctgaatgttttcgacccgcaaggcgttggccgagccggtgttttcgtaagggaagttaaaggaggccttcaagttatcctccggcgggtcgatccgggtcatccgggccagcatcttttcacgcgacttggccatcgtcgacttggaaccggccttgttcttcctgatgaagtgttcggccttatcgatgacctcctgttgtttttcgtactcgcgctcctggagggcctttttctcctctttttggcgcatcgcctgcttaaagctgccccggtacttggtaatcttgccaaaggagacgtcgacgatcgtgttggtgacccgttccaagaagtcgtagtcgtgggaaatgatcatcgccgccccggcgaagtcgtttaagtactcgatcaaccactcaatgtgggcggtatctaggtagttggtcggttcgtccagaaggatcacgtccgggttttccaagagcatcttggccaaaataatcttagagcgctgccccccggacatctcggcaaccacatgctccttgcccagttcgtttaagcccaacccggccatcacccgctcgatttcggtctccagcccgtagaaattatgggcgtcgagttcttcttgcaagcgcccggcccgggtcaagagccggtcgtccattttcgtggcgtagtcttggtagagttggttcatctggtcgttgatggcgtacaagtcggcaaaggcggtgtgcaagaagtcgatcaagttcatcccggccggaatatcgacgtactggtccaaatagccgatcttggtgtttttttgccactggacccgcccggcgaccggtaagagctggccgatcaagatcttaattagagtcgacttgccggccccgttttgtccgaccacccccatgtgttcgccgcgttccaattggaagttggcgtcatcgtagagctttttatcggcgaagctcatcgtcaaaccggacacgtctagtactgccatgaaaatcaatcccccgttttcagtctaatgattaattgtaacactaataggaagtgcgaaccaaccagtccaataatcgtgcacatggaagaaatctccccaggccctattctcgcaggttacacagataacgtactcaccaaccacaggcctagtgcctaagcaggccggagaacaacacattctgcgttaacccacgtcctagcttagccatacggcctgtcgagaaggttggttcgcactcactttctaacaaacaaattaaattattctcattttttagttgacaggttgagcgcccctccggtatagtggttacaaatcaaacgagaggagcagtcaacatgagtaacccatttatccaagtgaataacgcctggcaaagccggtaactcaggttgaccgtttacggatgcaacctgggatctttcagattgcatctgtaccggcttcaaagcatactttggcgctcgtacggatccacgtacgggcgtttcttttttcccaaaaggggcccgttaaacgcggaccccttttattttggaaaggagaaaaatcaatgaagcggatgtacacactgatcgtcttgctcgtggcctttttgggggtcgccttctttaaggagggtggcagcctcaccaccaccagcaagcctaaaattggggtcttaaccctgatgcaccacccggccctggaccaaatctacaagggctttgtcgacgaactagctaaggagggctacaaggacggcaaaaacgtcaccatcgaataccaaaacgcccagggcgaccagtcaaacttaaagacgatggccaccaagctggtgaatgaccactccacggtcctgtttgggatcaccaccccagccagccaggccctagccaacgccaccacgaagatcccgatcgtcttgggggcggtcaccgatccgaagggcgccggcctgattaaaaatgataaaaagccgggcggcaacatcaccgggatctccaaccaggccccggtcgccgatcaactgcgcttggtccaccagttcatgccaaacgccaagaccctcgggatcatctacacttcttcggacccgtcagccgaatcagaacacaagcaattcgtcgcccaggctaagaagatgggcttaaaccttaagtcctattcgatcgctaactccaacgacttggaccaggtttcccagcaaatgctgtctgaagttgacgccgtcatcgtgcccaccgacaacacgattgccggggcgatgcaaacgctagttaaaaacgccgacgccgctaataagccggtcttcccggcggccgacacgatggtcaaagacggcggggttgccacctacagtatcaaccagtacaagctcggggtggcaggggccaaggtggtcgtcgccattctaaagggcaaggccaagccggaaaccaccgccatcgaatacattcgtcacggggaaccagtcttaaacctcaagcaggctaataagctgggcctcaaggtaccaaaggccttcgaaaaggctgccgaagatcacggggaggtatttaaataatgactctaatcacatccgccatcggccaggggctcttatgggcgctacttggcctcggcctttaccttagtttccgcattttaaacattaccgacatgaccgtagaagggaccttcccgctcggggcggccgtcgccgtgaccctgatcgtccacggggtcaacccgctcttggcttcactagccgccaccggggccggaatgctcgccggattagtcaccgggctgttaaccaccaagggaaagattcccagcctcttagccgggatcctcaccatgaccgccgcttactcaattaacctgcggatcatgggcaagtccaacacctccctgctcggccaaaccaccctcttttccaacggtttcttaaagagcctaccccagtactttgactcggtggtgctcggtttcaccgtgattgtgatcgtgacggttttagtaatcttctttttaaacaccgattacggccaggccttcatcgccaccggggataaccccaccatggcccgctcgatggggatccggaccgaccggatgacgatcgttggcttgatgatctctaacgggatggttgggctggggggtgccttaatcgcccagtccaacggttacgccgacatcaacatggggattgggaccatcgtgatcgccctggcctcgatcatcatcggtgaagtagcctttggcgaactgacgctgggccaacgcctggtcgctgttaccctggggtcgatcctctaccggttgatcctcctagccgttttgcaactcggtttttcggccaacgacctcaacttactctccgcaatcgtcctcgccttatgcatgatgatcccgcaaattgaccggatcttaaacatcaaaaagccaatcttaaagggggttgccacccatgactaaaccaattctcgaactaaaaaacgtcaccacggttgtcaaccgcggcaccgccagccaaaccacgatcctcaaggggattaacctgacgatcaaccccggtgacttcatcacgatcgtcggaaccaacggggcggggaaatcaaccctcttcaacgtagttggtggcaacctgaccgcggacggcggccaactactccacaacggccaagacatcacccacctctcccaggaggggcggaccaagttcttagcccgggtctttcaagaccccaaactaggaacggcgccgcggatgacggtggccgaaaacctcttgttagccgaaaaacgcggtcaggcccgccacctggtcttccgccgcctcaagtcccggctgaccgaatttaaggccctggtcgccacgatgaataacgggctggaaaaccgcttaatgacggccaccggcgccctgtctgggggtcaacgccaagcgctctcctttttgatggcgaccctaaagcgccccgacatcctcttgttagacgaacacaccgccgcgctcgacccccacaccagtgccactttaatggcggcgaccgaccagcggatccgcgaagacaagttgaccgccctgatgatcacccaccacatggaagacgccatccactatggcaaccgtctcttagtcttgaaggacggccagatcaaagccgacctgaccggcgaagacaaggcgaccctgacgccggagaagttggcggcgtactttgaatagttgagtgcgacccagccattaggcaggccgtgggctaaggatagaacacaggttatcgcggtacgcggtgttctgtggtcggacttagccactaggtctgcggctggggagcacgttatgagtgagtgcgacccagccattgggcaggccgtgggctaaggatagaacacaggttatcgcggtacgcggtgttctgtggtcggacttagccactaggtctgcggctggggagcacgttatgagtgagtgcgacccagccattaggcaggccgtgggctaagctagggttgggagaagaatttctcctagcccttttctttgtcctcccctatcatttcgggcacaataactttaaaaacggagggctgaacaaaccatgcaaaccaacttcacgaaccgcctcgctcttgccatgcaaattgaccccgccgtcctctgggagcactttccaaatggcgtaaccattaatgatctccaaagggtcaacgagatactgtatcctgacgcccctgctaactttcactactgcttaccagaggatgttgcctaccgtttaattgacgctcccgggggtgaattagagagattttagttaggaatcacaatgcttggttcactagatggcccccatttggtaccaatcccggatgtatttccgcctatcaccacttcgttgaccaccgcaatgatggttattttgactaagaactaaaaaataagggaccgagaggaaagttgtttcctctcggtcccttatttcattgttgggttgaagaataatcgattagcgggccatgattcgctcaccgtgttgggtgatgtccaggccgaccgcttcctccctggccgaaacccgaaccggcatcacgaggcgtaggcccttgatgatcagccagcacattaccccggtaaagaccatcgtggctagggtagcaacgatttgaactaagaactggtgcatcccgccgccgtacaggagtccgttgtcggtaacttgggagttaacctggctggtggcaaagagcccggtggcgatgcttccccagatcccggaaaccccgtggcaaccgaaggcgtccaaggtgtcatccaagtgcaaacgtggcttagcgtaggtgacgaagaggtaggaacaaagggacgcccccaggccgatcatgaccgccccgctgatggtgacgtagccggccgccggcgtgatcgccaccaacccgcagacggtcccggtgcaggtaccgactagggaaaccttcccggtaaagctgacttccagtagttgccaagcgaccatggctaccgcggtggccaccgtcgtcgttaacatggcttgaacggccacgttgtcaatcgctagggccgaaccggcgttaaagccgtaccaaccgagccacaggatggaagtcccgatcaaaaccaagcccaagttggccggttggtcgttgtgacgttgcaaacgcggcccgaccatccaggagaggaccaaggccgtcaccccggcgttgatgtggacgacggtcccgccggcaaagtcgagcgtccctagcttaccgaggatgccgccgccccaaaccatgtggactagcgggtaataaaccaagagcgaccagaagatgacgaaggcgacgatgaaccacggccgggcccgaccaaccaccgccccgatgaagagggccggggtaatgatggcaaacatcatttgaaacatcgagtacaggccggttggaatcttggtggccgtcagggcaaagatgttaacgtggtgaaacatcgcccagtgtaaattcccgaacaatccccaaacgttaccggaaaacgacagggagtagccaacgatgatccacataatcacggcgactccgcaaatgaagtacaccgacataaaagtgttgaccacgttcttcttttcgcttaaccctccatagaataaggccaagcccggtgtcatgaaaaagaccaggatgcttgcgaccatcacgaacaatacgtttgctgcgttcatctttcttcaaccccttccgaattaatgttgataagattagaccattctaatcaccttcgcaaggggcgccgcttggtttgtggatatcttttgtttggtggggttaaaacggggcttttttaagttggtagcggttccaacttcttattttttcgactagaccaattttgcacttgcacgctccttcgcaattctcctacaatggatataatatttttcaagaagggaaacccaccatggagcaactatttgaacacacttcgatccgccgcgtctactttacgctggcgatgccggtcgttttatcgatggccgtcaccctaatttacaacatggtcgacaccttcttcgtcgcccaaacccaaaatcccgccctggtcgccggggtttcgcagggggccccagtcttcacccttctaattgccattggtgacatcttcggactggggggctcgtccgtgatctcgcgcctctttggggaaaaacgcgatcaagaggggcgtaacgtttccggctacgccttttacgccgcctttttctggggcatcatcgtttccgccctgatgttaatctttaaggaccaggccctacacttgctgggggctagcaaggcgacttggaagtacgccgatgaatactacaccgtgatggcctggggggcggcctttgtcgtctttggcctggccccgaataacatcttgcgcaccgaggggttagctctagaatcaatgaaggcctcgatgaccggaacgattatcaacatcgtcttaaacccgatctacatcttcaccctcggcctgggggcggccgggtcggcgctggccaccgtcacctccaacgtaattggtgaccttttaatgatttactacctgcgcaccaagtcccaaaagctgaccacctcgatcaaggaaaccaaggtctcctgggaccttaagcgccaaatctacgcaatcgggattcccgccagcatcaccaacgtcatggccaccctagcgatggcgctgaccaaccgctacctaattgactacggcgccgattccgtcgccgccatggggatcgcccttaaggtatcgatgatcatcaacatgatcttcattggcttcgccttcggggcccaaccgctgatcggttacgtttacggtgccaaggatcggcgccgtttccagggcgccctgcgcttcgacctgttagtggtctgtggttttgccctggtcatgacggcgatcatgttcttcttagccccgatcatcatcacctggttcatgaaggacccgacgatcgtcaaggagggggccatcatggttcgctggctggttatctcttcaactctagccggcttcaccctggtctttacaaccgtcttccagtcaatgggcaaggccctgcccgccctgctcttgtccctggctcgccaagggatcatcttcaccgtggccatcgtcattctcgcccacttcttcggctaccacggcattatcgccgcccaggccgtggccgaccttttgaccgccatcttagcaatcgccctctttgcgcggtataagccgaaattctagttaaaagaaacgggacccaacctccgctgcaggcaaatttaaaagccccgccgcgttcgttaaacgaacgtgacggggcttattttggatgcttagttttttacggttactcagataacgtgctcaccaaccttccccctagcttagcccacggcctgccaatggttggtccgcactttaaacgcagtacaccaatggactccattggttctggcgaccccgctgaagtcctattggtgtttgcgggggtgcgactacgaaatcagagatttctgtcgcactccctattccgtagccgcctgcaacgcgagggcaaagtccccgatcgtggccgagccattgtttttggccatcggcatcgtgatgtactggtcgaggtcgcccacttccacgtagtcgtttaagagcttcttgaattccgcccggaccttctttaagaagtcttcggagatgaccccaccaccgaagacgatttgggccggccggtacatcagggtcgtatctaaagccgcttgggccacgtagtatgccatgatgtcccaaacgtggtcggtcagcggtacttccttccccggcttgcctaagcgggcgtcgaaggttggcccggaaatcaaaccttccaagcagtcgccgtggaacgggcaaatccccttaaagtccaggtcatctgggtggcgcttaacgcggatgtggcccatttcggtgtggccttgttcaccaacgaagtgcccgtcaatgacggccccgccgccgaccccggtcccaatggtgaagtaaaccagggagtgaatccggcggttaaataaggttgccatcaggtattccccgtaagcggagccgtttacgtcggtcgtccaagcgatcggcacgttcaaagccttcttgattgggccaacgaaatccacgtttgaccaacccggcttcggcgtgtcggtgatgtaaccgtacttcggtgaggagcggcgaatttcgatcgggccaaaggaggcaatcccgatggcggacaggttgtcgaactgcttaaagtaatcgataatcttacccagcgtttcctctggcgtcgtggtcggaatgtggatggaatccttgatttggtagttggtgtttccaacggcacaaaccatcttcgttccaccagcttcgattgatcctaataacatggtcatggtaattctccttttagtcgtccatttctttcttgagttgttcaccgatttcttcaaagcctggcttgcccagcaggccaaacatgttggtcttgtaagcttcgacccctggttggttgaacgggttgatcccgtttaggtaaccggaaatcgcgatcgccacttcaaagaagtaaatcaggtaaccgagggtaaactcgtcttctttggcaatgttgacggtcatcaccggcacgcccccggtggtgtgggcagcgaccacggcccggtaagcttgggtgttgacccaatcaatttccttgccttccaggtacttgaggccgtcgaggtcgctcttggcactcggcaccttgacgttatggtttggttcggccagcttcacgaccgtttccatcaggttacggcgtccctcttggatgtattgacccagggagtggaggtcggtggtgaagttagcgctggacgggtaaatccccttttggtccttgccttcggattcaccggccagttgcttccaccattcggccagcatcgtcatgtttggttcgtagttttccagcagttcggtcgtgtatcccttgcggtacaaaatgttgcggtaagcggcgtactggtaagcctcattttgggtcagatccgggttgacgtaggtggcttcggccttggcggccccggccattagttggtcgatgtcggcgccggaaacggcaatcggcaagagccccacagcagtcaggactgagaaccggccgccgaccccgtccggaatcacgaaggtttcccaaccctcggcgtcggcttcggtctttaaggcgccgcgctgacggtcggtggtggcgtagatccgggcgttggccccgtcgaccccgtacttgtcttccagcagttggcggaagacccggaaggcaattgacggttcggtcgtcgtcccggacttagagatcacgttgaccgagaagtcgcggtcgccgatcacgtcaatcaggtcggcgatgtaagaagaggagaggctgttgccggcaaagaggaccagcggttgcttgcggtccgccgcggtttgggcctggtaaaaggagtggtgcaagaaatccaccgccatccgggcgcccaaataagagcccccgatcccgattacgactaagacctcggaatcggcttggatcttcttggcggccgccttgatccgggcgaactcttccttgtcgtagtcggttggcaggtgcagccagtcgcggaagtcggcgccggccccagtgccgttgcgcaactcgctgtcggcggcggtcaccatcgcctgcatttcaccgagttcgtttgggtgaacaaacttctttaacgcacttgaatcaaacgataacgtttccatcttgatgtcactccttaggtaaatctcaatcgcgcgttttcagttttatgaaagcgctaactccatttctcggtttttataatagcttgcttactgccatatgtaaaccggtttgtatatatttttcaaaggcgaatttacaattgaaatgcaacacaaagtaaaaaaataaacccataccgggtagaatatgtttaacgaccaaattaaacaattcgaggtatccggtatgagctataaacatcttactataaaagaacgtgaaatacttatgtttttacgagctaaggggttatctatccgggctgtcgcgttacggctggggcgaaatccaagcactatttcacgggagttaaaacgttgtgcaggtaattattccccaagcaaagcagataatgactatcatcaaaagcggcagaattgtcacaagaagcggctattagacagccatccacaattacgccgtcaaattgttcattacatcttagatctgcactggtcaccagagcagattaccgctcgctttaataaggaacatcaatggtgtgttagctacaacacaatttaccgtcatatctatcaacacaatttaggtgaaaagtactcctcacgtggtgataccggtattcagcgccatctcagacataaacatcggacccggcattcaaagaatactagacgacatcgagaagtacagaccgactatatctcgatccatgagcgccctggttttatcaaccagcgtcaacgtataggtgactgggaaattgatactgtgattggtcgaacgggtcactccatccttttaacggttgtcgatcggcttagtcggcttacgcttatcaaaaaggttatgcaaaaggactcgcaggagataaataaaggcttagttgaactgttaggggccattcctaaagaatttgttcattctattacaccagatcatgggaccgaatttcttcatcttgatgaaatcagcgaaaggttaggtattactgtctattggcccgatccatattcgcctgaacagcgtggaacaaatgagaatacaaatggattaatccgggaatattttcccaagcgaacagatattgataattatacagaacaggacgttgaacactgccaaaagcagttaaatcaacgtcctcgcaaagtgttaaactatgaaaccccatatgaagtattttttgacaaaccgttgcacttagtttgacaattcgccaaaaaaaaaaaaaaaatcccccgcccgcactgcgaacgaggaatagcgggggctaagcagtcgtcccctcaactaactgaaacttgaaagtatgaagacagactgatcccttggtatcacagggcatattttaattaatttaaccatttagcttgctgttaacagcgaaactaaccgtttcggcaaaaatgtgaagaactgattcatcatctgaataatttgggctcttcttgcataaacttcatgattaataatcgtttttaacgaatttagaagccataccagtgcttgagacaactcaatatctggcatggcttcgttcattataaagaataaatccccaatggtgcgatcatcctgattttgccgctcctgccaagctaataggtcataagtcatcatgacaattgctaaatggccacaaagcccgtcataattttgaacttgtgatttgtcgagccgcaagtattgcttggcaactttaaagtaattctcaatttgccatcttcgggcgtatagttgaatgatcgcttgtggctgaaggcctaactgagtcgttgccagtactaggtagtcatcttgacgggcccgattagccacaaataccaagcgaagcttgaatttttggttcccgacgtgcgcttcgacaaagcagctgtattgataagcttgcttgggttgatattttgaggcctgcagtcgcttgtataatgctttaactgaatattgccgtccgcgatattgatagtaaattttgctggaccgtttaagcatgcccacgccgtttaatcccaacttggttaattcatagaacatttttggtgagctataccagctatcaaataacacatagtcagctagaacgccatttgcgagggcttgcttgacaagttgcaatgaaacgaggttcattttttgctgtgcttggcgacgtctccggccagcaattgttcgttgatcggttgttttagctgattttccaaggacgttttgtggcttcttggaagacattaatgcaaagttgatcggtaagaatgtattggcgtcactccaacccaaagttaaagcccggtatcccttaatatataactgtttgtcatggtcaaagactcgcgctagtaattcggtttgggtggcgtactcacgggaaaagagtgtatcgtcaatgatcaatgctaaccgccgccggcggtcaataaacggtcgtaaatgcttgattaaatgactcccaacttgacaaatcaagcgttgccaattgatccggccatcgttcaaattatttctgacggtgcgactggtaaagttaggtatttcatgggctcgataaagcgagcgtcccaggaactttgtcgtgagcagccattcaatgaccttcatcaagctgatttctgaattccggcgataattcaccaacttggtgagtttagatagaccaatgagggaagtaaattgatgaacaatattgtgaagctcgttttctgtatttttttgtcttataatattcatgacgtaagtctcctttgtatcttggttttggtcgactaaagtatacaacgcaggagagcttgcgtttatttttttgccaaaaaagccaataaccacacgcctttggcgtgattattagctttcaagtttcagtcaactaatttaaccggcagggtccggtactgaacggcgggttccccggcgattttttccttcagcaattccacggccgcctcggccatttcctgaatcggctgttggatggtcgtcaactctggcaagagcaagcgggtcatatcggcgccgtcaaaaccaatgatcttaatgtcttctgggcaccgccgccccgcttcggtcgctgccgtgagggccaaacgggcgttggtgtcgttatcggcaaagatcccatcgacttcggggtgttcctcaaagatcttgcggatccggaccagtttttggtcctctggttcatcgaagggcacctggtagacaatcgccggccggtcgttttggctcattaagtcgcggtaggcgctctcccgggcctggtttggcgaggcaaagccccccgggtagttggtgtgaatgatatgttgacagccgtcgtcgagcaggcgttgggtggctagccgcccgccctcgtagttatccaccgacaccaccggcacctgattggaaaccacccgttcaatcgaaacgattggcaggctggttttgtggtaggccgggatttccgggttgtgggccccgacgatgaggccatcgagttggcggtccaagaggagttgcaagtagttctcttcctttttggcgttgttttcgctgtttcccattaccgcccggtagccctcgttgtagaggcacttttcaagggccgcctccaactgggcaaagtaggggttattgatggtcgggaaaatcagccccaccagcatcgtctcttgtttgtagagttggcgggcaattgcgttggggcggtagttaaggtcctccatggcctggtgaaccttatcaatcgtcttttggcttaaatacccgcggtggttcaacacccgcgaggccgtggccttagaaacccccgccaagcgcgccacgtcgtctaacttaatctttttttccatcttctttctcgtccttccaccagagtttaattagggcttgggtgcccaagtcgccgtggcctgagtccaccagctgttcgtagagttgttttgcgaccttagttgccggtaggtcaatccccatggcgtccgcctcttctagggcgatgcgcaggtcctttaggaagtgcttagcaaagaagccgggcgtgtaatcgtcctttaggatccggggggcgtaattggcgaggctccaattagccgccgccccaccaccgaccgtggcgaccacgtcttgtaaattgaggcccgccgccttggcgtaaaccagggtttccaccagtccggtcatcgtgccggccaccatgatttggttggccatcttggcgtgttgccccgccccggcggtcccaaagtagtggatatccttgcccagttgcaaaaagaccgggatcatggtttggtaggcttcttggtcgccaccaaccatcacggtcagggtcccttccttggcccccttatcgccgccagaaactggggcatctaggattcccactccggccggggtcttttgcttaagttctcgctccaaactcggcttactggtggtcatgtccaccacgatttgacccggctggacaacgctaaagatccctttaggtcccaggtaggtttcttcaacgtccgtcggaaagcccaccatcaccatcacggcctcgctatttaaggtggcctccgccgggctagccgcccaactagcccccgccgcgagtacctcctcggcgtgggctttggtccggttgtaaaccgttacccggttaccagccttcaacaaatttttgacaattccggtgcccatgaccccagttccgataaatccgattttcattttcttcgccttcctttgttaacaatagtaaccggtttcttattgattggaaagccattttgatgataaataaaaagcgcaccccgctttagagtgcgccttaaaagtttgtgcagtaattagtttttcaaggcttcttctacttgggcccgggttgggatcgatggcattgcccccatcccttgaaccgtcaagctggaggcccgttgagcgtaggtaatggcatccgccaggttttccattgacggggtcagttgggaaaccagaccgccaatgaaggtgtcgccggccgcggtcgtatctaccgccttaaccttaaaggccggcacaatcccgctcttgccgttgtggttgaagtacgccccccggctacccagggttaccaaggtagtagctaccccttggccccggaagtagtccgccgtcttggccaggtcagcctcatcgttgatttcaattccggttaacagggcgctttcggtttcgttaggggcgatcacgtcggtcaccgccagcaagcccggtagaatttccttggctggggccgggtttaagattgtcgtcaccccgtgttccttggccagcttaaaggccgccagggttacttcttgcggagtttcgaactgactaaccaaaaagtcgacttggtcccacaggtcgtcggtccggtctaacacagcggtggtcatcgcctggttggcccccccgtaaaccatgatgtcgttttggccgtttgcgtctagggtcaccagggccgtcccggtcccgtggcgaacgtcattgccaacaaactgggtgtcaacgccgtcttcttgcagggcttcacgcatgaaacgcccttcgttatcggcgcccaccatcccgatgaaggtcgtctgcgccccggaacgagcagcggccacggcttggttagcccccttgccccccggtgccgagctcttgtcggtagccgacagcgtctcccctggttccgggaaccgagcgacgtggtaggtggtgtctacgttaatactccctaaaacggcgatgcggttagtcatgattttcctcctctggtgcgttcgttttcagtaaatcgttttacgttaattgatcgtttactagtataccggacttgtaaaccggttacaagtaaaagttgagtgctaaacaacctcctcggcaggtcgtatggctaagctaggacgaacggttggtgcgaaacgcaccgttcttcgtccgtacttaggacctgcggttggttagcacgatatctgtgtaaacttagggaatcgtgaactactcgaccataaatgaccgagcttctgggaacacgaagtagtatttaggatgttgcttctgtattcagaatacctaacttacagaactccgttcttttaccacggctagtccctagccaacggcttttaatcctctatggagtatattaactgccgcattaatatctcgatcgtgatgagtaccacatttaggacaagtccattctctaatttcaagtggtttcttcccactatggtaaccacacgtgctacagatctgactggtgtaattaggattaacagtaattaactgtttaccgtaccaatcacacttgtattccagcatggttctaaattggtaccaactggcattcgcaatagctttagctaaatggtgattcttttgtagattcttggctttcaaatcttcaatgacaatcacatcgtattttttaactaaggctgttgttagtttgtgtaagtaatcttgacgttggttcgctatctgttgttggtagcgagccttttgtttttgagcccgttgccaattctgataatcattgagatccatttttacgtctttatgattatggttccattggcgaacagctacggttgcttgatattttcggcgactatacttgctttgccactttgtggcttgcttttccaaccacttagcattgaaagtaccaaacttttcaccgtcagaactaattgctaagtcagcgataccaacatccaggccaacggtcttgcctgtttttggcaatgcttctggagcaacagtctcaacctgcaaagataagtagtagcgaccagttggaccatagctgacggtataacgcttaattttgccatttacagcttgagaggtcttactagttcgaatgcttcctaacttaggtagtttcattcttctcttggcaatcactgtgcagaccgaccgaccagtatatgaccgtttggcggcatgcctgcttttaaagcgtggatagccaccacgatgtttaaacagcatcttaaaagcttggactagattatggttcaccacaaggaaactagtcgcatcgctgtctttgagatagggatattcttgtttcaactgtttaagcaagtaattcattccatattcatttacaaaatgactgctaggattgttttgatagcgttgcttagccatatctagcatgagattccacactctacggtcattgccaaacatttgccatagttgagcttgttgttgcttgttagggtacaagcgtagcttgacccctttaattaatttggtcattctaatttcacctcctttttgcgttgatcatcaatatacttggctactgcttgttcattaacgctcccaatgctttcaacataataacttggtgaccataggtgacgaccttgctttttccagtagctagtttgtagttctggacattctcggaagaggtgccgtgcagaaatgcctttaagccagcgcatgatgttagttacagacagttttggcggagcgctcactagtaagtggatatggtcatctttaccaatctccatatgagcaatcgtaaatccatattttgaagctatatcatataatgattgcttcaagacttcttctacgtgtcctttcaacactttattacgatatttagttccccaaattaaatgataattaagattgtagactgacgttctaccatatgtaattctttttgtatctttcataccaataattatattacattacggttcgatcatgtgccctaagagcacaaaaaaaggcaattcatcacgtccttaaaagaacgtgtttccttgcccgctttcaaaaaggtgaccaagaaatcactgattcctgtcaccactttctctatccctcactaagtttccgttccaagtagtgggctaagcggtccttcgggtagagccccgtcaccttttctttagccttcccgtcccggaacaagaccaggctcggaatgctcatcaccttaaattgggtggccgtttcctggtcctcatcaatattaaatttgacaaacttaatccggtcgccgtactcggcttctagttgatccataaccggcgccatcatcttgcagggcccacaccaaggagcccagaagtcgaccacggtcaccgggccttcaactagttgattaaagttatctttgtgtgccacttgtgccatcttttttcccccctactgacttgctggaagaagctgggtgcttcccccggcgaaggaagtgtaccaccccagtcagggcaaagaccagtaaaatgaaaatcccgaagatccccgaaggaatttcgatgtcaattgccgggatcgtcaagaacagcttaacggcgatgacgacaattaatacgtaggccattggctccagttctggaatcttccgcatcaaacgcataatgaattcggcgattccccgcatgcacaagatcccgatcagtcccccgatcaagacgatcaccgggttgttggagacggcaagggcggccaagaccgaatcgacggaaaagacgatgtcggtaaactcaatctgcgccacgacggcccagaatcgcttacgcccggtcagcttcccaatccgggaatttcctttatccttgtgcaaggaatgcttaccgaaaaacttaacgtggaagaagcggtaagccatgtaaatcaggtaggccgccccgagggccttgatttcccagaagtgaatcaagtaggtcccgatcccgatcaccaagaagcggaacagatacgaaccccaaattccgtagaagagggattcttcttgttcccttagggttggcaagacccgggtttgggcggctaagacgacggcgttatcgacggagagcaaacactccatcattaccaaggacaggatgattaaccagtcctgtccggaggttacgaccgccgcccagttgtgtaagtcaaagaatggtccgtagagattctcaataagtgacaattaattatgcacactcccttatattgttgatttgtgacttgtctacccctattctatcaaaactgggggaaatcgtcagggattttagccacaatccgctcccgttttaacgaaaaggggaccaccaattcctgggccaccccgtgtaaatacatccggggagccgccaccgtgccgtacaacgggtcgcccacaatcgggcagccagccgccgccaagtgcacccgtagctggtgggtccgcccggtctcgaggttcaaaaccactagtgcctggtcgccattgacggctagggtccggtaatgggtccgagcgggctgggcgtttttgccgaagaccttgcgcttgcgaacgtcggtcgggtcctgtcctaagggaaggtcccaaatcccgcgggccgggttcggcaccccggccaccagggccaagtagtcacggtgaatttcgccggtactaatcaactggtctaaaatcggcaccaccaccggatttttggccacgatcatcgccccgctggtttcttggtccaagcggtgaaccatgtaggcggcgtcgttagtcccctctaaataggccgccacccggttcatcagggtgccgacttcgcccgcttggttggggtggcttttaattccggccggcttgtcgaccaccaagaggtcccggttttcgtacaggacggtcaacggtcccggatcgggaaggtacgatgaatcgggcgtgcgaaactcgtcgccggaaaaattaagcgtgatcacgtcgccagccgcaaccgtcttcgacaccggacggtaggagccgttgactagaacctgacggcgactgcgcaggtagtggaccaaacgcttgggcaacagccactggcgctgcaaaaggtgccgtaagggcgttgcctcttgatccaccggcaggcgttcttctatttgccagcgatattccatcatcattccccctttgtgactattgtaacctagaccaagggattggcaaactaccaagggattggcaaactgttgtataatgggaaaagctaagaaagaggggtgtgcaatgtgttaagttccgtcaagtttaatgaccacagttactgggtgtcggtctttgagcccctcccccacgaacgcgatgaactctttgaaaaatacgaagtgacgagtgatctgcttgactacgccatcgacccctacgaaaaggcccggattgaaatcgatcgcgacgccgggatcaccctgctcatctttgacgtctacatccctaaccacgaggaatcggccccccagaccgccccggtcgggatcatgctgaccaaaaacaacgtcttgacctttaccaacgcccacactaacttcgtcaacggcttaattgccgaacaactccagcgactccaatctcacggtgacatcgacacccgctacgacttcatcttgccgatcctctaccggctgtcgacggcctacttccccccaattcggcgggccgaccaacagcgtcaaaagatccaaaacaacttgcggcgccggaccgaacgctcggcgatcaacgagtttatggaactggaaaccgggttggtctacatcttgacctccctgcagggcaacgtttctttgctccaggaattcaagcgccgcttcggttaccggatgagcgtcgaccagcaatccgacctggacgacgttatcatcgaagcccagcaggggttggaaatggcccagatgacctcggacgtgaccggccgggtctccgacgcctacagcaaggtgctggattccaacctgaaccaaacgatgaagtttttgaccgtctactcaattatcttatcgatcccgccgatcgtctctggtttttacggggaaaacgtcaagtccctcccctttgccaacaacgactttgcttggcaaatcaccatcatcattaccctgatcatggtcgccatttcgatttggctgatctttaacaaacggtggtggcgttaattttcggaaaataacgatgattaagtttccataagattgtatcgttcgcttttaagtggtaagatactggtatcaaatttagaaaacgtaagtgcctatataatcgccgtaatatggtcggcaagtctctaccttcagccgcaaactgaagactataagcaaaagtgagtgggcttttgtgggtccacttttttatttaggtacctgcggggaggaatcttttgaaactttcaccgtcaatttccgctgaacaacgcctggaggggcaagcaaccaccttctggcgccaccttatcctaggtttccaacacctgttagccatgtactccggtgacgtcttagtgccgttgttgatcgggaactacctgcactttaacgccgcccagatgacctacctagtttccatcgacatcttcatgtgcgggatcgctaccttactccagttaaaacggaccgctttaactgggatcgccctaccggtggtcctgggctgcgccgtccaggccgtcgcccccttggaatcaatcggcggcaagctcgggatcggctacatgtacggcgccattatttgctcggggttgtttaccttcttgattgccggcgtctttgccaagctcaagaagctcttcccaccggtggtgaccgggtccttgatcacgatcatcggtttcaccctggtaccggtcggttttcaaaacctcggtggtggggatgccacggcgaagagctttggtgcccctagcaacctcttaatcgggatcgttacgatcatcatcatcgtcatgatcaaccgctttgccaagggctttttaaagtcgatcgccattctgctggggatcttactggggtccttatttgccggcgtcttggggatggtttctttaagccccgtcgccagcgccgcttggttccacgccccacagttcttctacttcgccaccccgcaatttaactccagtgccatcgttactatgatgctcgtcgccttaaccacgatgatcgaatcaactggggtctactttgccttaagtgacgccaccgacaccaagatcaccagcaaggacatggcccgcggataccgggccgaagggattgccgccatgcttggggggctgtttaacaccttcccgtactcgactttctcgcaaaacgtcggggtgctcaagatgtccggggtcaaaaccaagaagccggtttactacgccgccttccttttgatcttgctgggcttattgccaaaggccggcgcccttgccaccatcattcccacgcccgttttagggggcgcgatgatcgtcatgttcgggatggtcggggtccaggggatccaaatcctgcacaaggtcgactttgctaagggttccaacctcttggtggcctccctgtccgtggggttaggcctcggggtcaccgtctacccgcaaatcttccaacaactgcccaccgaagcccaaatcatcttgggtaacggggtggttgtcggttcggcctgcgccgtgatcttaaacctaattttgaactaccaagacttcttcaaaaaggaagccaagtaaaaaaggacccgcgtcggcgggtccttttttacttagccagcaattccttgatgctagcaactaacgtcggcagcgggtgaccgaggacggtggccaagtcatcgcttgtcacatccaagtcccccgcctcgtgcggttcttcaaaggaggcgatcatggttgccatcgcctcgtccatgccactctttaccaaagcggcttcataagcttcccggcttagtttagccacttctacctccttgcccagggcttcttttaaggcgtccccgagttcttcgtagctgattggttgaccgccaaattcgtaaacttcctttggctggtcactcaccagcaccttagcggcggcggtggcgtaaagggcttccggtgcccaagctgccttaccagtggtccagtaaatggccgcttgcccctccttgccagccgtcaggaagctggcgtcgttttccaggtaccagttatcacgcaagaaagcgtgggcgagcccggcttcctttatggccgcttcagtcacctggtgatcgtgggccaaaggagccttagcttggtccgcctgcgggtagctagtgtaggcaaccaaggaaacgccggcttccttcgcagcggcaaccacgtttaagtgttgcgtctcccgggaaactggcccccctggttgtgaggaaataaagagtaaacgatcaatgcctgccaaggcactggtcatccccgcttggtcggcgtagtcaccctggcgaatttcaattcccgccggcaatagctctcgccccttggcaacgtcgcgtacgatcgctaccacttgatccttaccaactaaatcaaccaattgttcaacggccacccgaccaaaacgtccggttgctgcggttactgcatacttcatcatttacttcctccttcggttcatatctgttactttttaaattacaacattgattgtaacatatgttattttattatcaacaactatagccgaaaaaagaggttagaagaaaacaaggttttcttccagcctcttgctgtatgtccgaatattagacagaaaacgtggtcaataaccgcaagcctagtggctaagtacgggcaaagaacggtgctggcgcaccaaccatttgccctagcttagtcataaggctcgtcgaggaggttgggtcgcacttccttttttaatgattataaaactcaacgctgacccggtcgccatccatcaccaacttggataggctcccgtttgccggccgttcggtaatgtcatacttcccctcgccgaaacgttcaatcaaggacaggcaggtgttgccgtgggaaaccaacaaaacgttggccccgtccggcagccccgcgtcccgaatgatcgctaagccttcgttcatccgtttccagtactcggtgctgttttcggcgtcgtggaagggatcggcgtcttttaaccagtccttggcggtgtcgatgttgtacttggtgacgatgtctttgaaggtctttaacccgtggggagccccggcgttataccaagcttggtccatataggtcccttcgtaagagccgtagaactcctcgcggaaatacggtgccgtcgttggctccttgaccgaatcggccttattttcatcgaggattgtttgggcggtttcaacggcgcgggtaaggtcggaacaaaaggcggcgtcaaagtggacgtcctttaagcgttgtcccgccttttcggcgtcttggtaaccctggtcagtcaagggcgagttactccagccctgcagcttgttataaatgttgtagtaggtttgcccgtggcgaacgaggtaaatattgatcttggtcatcgtcatccctccattgttagtgctttcatgccttattgtaccccattttcgggttgaatgtagcggcgccccgctttgaattccgttaagtttcttcaacgatttttcaaatcccccaactccctgctccccctatgttaaaatgttgatcgttaccggctaatttacttagccccatcgctttaataacgaaattatttatgtttgcgaggatcactttacgatgaaacgactcggaaaattcgtgaacacccggatcggcttttttgcccttctggtggttctcttttgggccaagaccctctttgcctactttaccgactttaagttgggcgccgagggaattgtccaatacgccatcctgttagttaacccgcttgggaccaccctgctcttattcggactcgccttttactttaagcggtcccgcttcttttacccggtcctgatgggaattgacgttctaaataccgtcttgctctatttaaacgtcatctactaccgggaattcaccgacttcatgacgatcgccaccatgaccggctactccaaggttaaccaggggctgtcgggaagctcgattgctctgaccaacctccacgacgtcttttactggctagacatcgtggtgatcttagtcttgatgctctttcgcaagatcaagttcgatccgcgggcggtcagccaccgagtcgctttcgccttcacctcggtggccctggtggtctttggggtgaacttggcggtcgcggaaatggaccggccccaactactggggcggacctttgaccggacctacatcgtcaagtacctcggcctagatacctttaccgcctacgacctagttaagaccgagcacgtcaacgacatgcgtaagtcggcgaccaagtcggaattagaaaaggttaaaaagtttaccgattcgcactacgcttcaccgaacgtcaaaatgtacgggattgccaaggggcggaacgtaatcgttatccacctggaaagcttccaacagttcctgattaacttgaaggtcaacgaccaggaggtaacgccgttcttgaactccctgtacaagagcaaggagacctacgccttcgataacttcttccaccaggtcggtcaaggaaagacctctgacgccgagaacctgctggaaacctctacctttggcctctcccaggggtccttgtttgccaccttgggtagtgacaacacctttgaagcggcgccagccattttaaaccagcgggccggctacacctccgccgtcttccacggtaacgtcgcctcattttggaaccgtaacaacgtctacaaaaacatgggttaccagtacttcttcgacgcctcttactacgacacgtcgggtgacaagtcgaccggctacggcttaaaggacaagcttctctttaaggactcgatcaagtacctagaaaacctgcaacaaccgttctacgtcaagtacatcacggttaccaaccacttcccgtttgacctcgatagcgaagataccgacccaaactttaccgccccggacaccgggagcaccacagtcgacaattactttgtcaccgcccactacctcgatcaggcggtcaaggaattcttcacctacctcgataagtcgggactggctaagaaatcaattatcgtcttgtacggggaccactacgggatttccaacagcgaaaacaccgccttggcctccgtgctcggtaagaatgccgacgactggaccgactttgacaacgcccagctccaacgggtaccgttaatgtttgtcattccaggcactaataaggggggcgtcttcaacacctacgggggcgaagtggacgtcttaccgaccctcttgcacctgctgggcatttccaccaagcgttacatcatgtttgggaccgacctcttctccaaggagcacagccaggtcgttgccttccgcaaccacgactttgtgaccccgaacttcacctcgatttcggacacgttctacagcaataagaccggtaaaaccgctacgctgacggcggccgaaaagaagaaggtcaaggccgacgccaagttagtcaacgaagaactatccttatccgactcgctcaaccaaaagaacctcctgcgcttctacacgccgaagggcttcaccaaggtcaaggcaagtgattataactacgccaacgggctgaagaaagaagaggcgatcgaaaagaaacttggtaacaagtcgacttcgctcattaatgaaaacggcgggaagacaaccgccgacgtcttcagtaccgatgccccagaagtgagccactcttcgactagttcgaaccggattaagattacgaacccggatgataataataattagggagcacgacagaaatctctgatttcgtcgtcgtgcccccgcaagcgccaataggattccagcagactcggctttgtcgagccaatggggtccattggcgtactgcgtgagaagtgcgactagccttctcgacgagccgcatgactaagctagggcaaatggttggtgcgccagcaccgttctttgcccgtacttaggcactaggctcgtggctaggagcacgttatcaggaagtgcgacccaaccattggtaggccgtttgaccaccacgcacctacagaataaacaaaaaggccgctcgcagcacctgctgccaacggccttttattatggatcccggcgtggtcgcggtccactttgctgtataattaacttgataaaggaggagattatgatggcaactgttttcgtcgcccacgttaagttaagttggggccaagaggccgattatttgatcgctaacgacgtcgaaccgggcctggccagccgccgggatcgcggggataacgactggaacgccgtgatgctaaacgccttgattaacgtcccggttgctccctacctcaaagacaaccgcgtgaccccgccaattgcgaccgggctggttactagcctaaccgcggtagaagcggggcccgctaccgctaagctcttacggacccgtagccagttcatcatggccgaaatgtggcaaaaacaagacgtttccgttgacgccacctttttgcaccacgaccacccccagctgagtcagtcccaaatccgtgccgacgttgattactggctcaaccaccgccgccacccactgatcactctaatcaccaagtggcgaatccggcttcagctagcccgggtcaaaaaagagaagtaggaaacagctagttaacgggccattgggctaagaaaggtgattcttccctctcccattagcaaactaaccaataaaaaaggacgcctagtggcgtccttttttattagctaatggtcactacacggttctggcgggtaatcttcccttcttcttgcaggtggcggaacttgcgcgacagagtttctggcgttgtccctaggtaggcggccaaatccttcatcttcatcggcagggtaaagcgcccacccctttggctggccaggtgggataggtaggcccacagacgttcttccaccccgtcaattaccaaaaactggttttgggcggttaattcccgcaccttggccatcgtcagttgcaagagccgggccgccaattccgggtactcggctaaaaggttggtaaaggcgtcgtaagttagttcgcaaatggcggcgtcttgttcaaccaccgcaaagattgcttcattggcggccccgtaagccactgctcgcccacgtactcgccagtccccagcaccgccagcacctgttcgtcgccgttttcgctgagttggtagagtttcaaccgtcccgcttcgacgatcattagctttccctcgtcgcccggggaaaggataatttcacggcgttggtagtggtggtggtgcaccatggtttcaatccgtttttgatccggcaaagacagttggttaaagagcggtaccagtgaaacgcagaggtgctcaccattgatcgtcgtcatcatcttcttgataccttcccgtcatcaaattatttcccaggaaattttgcccggccaaaatttgcgtccgcatccaggtgtcgaggtcgactagggtgtgaactaacttcatcaacccttcttttttaccgagggcaatcgccttttggaggaagagcagttgggtgtcaaagtccttgattaggtcaaggagctggtccttgcccggagcatacttctgggcgccgttttcctttagcatcgtgtactgggtaaactgagcggttgtggtcggtaccgcctcgccattgatcactagcagttgattaattcgatcaaagtattggcgttccgtgttcaaccattcgcccgtgtactgagccaaaaagaggctggcgcagcccttggcaaacaggcgggcctgattaatcttttgttggtggagccagaggttagccaaaatatggccggtcatcgccccggccgtgggggtgtggtggtcgacgtcggcttgctttaactccacttcgtattgttcttggatctccattaaactaactccttttccttaaccttattaacctgataaccaaggttttcgacgacctgcttcaaatcagcggccgtggtttggtcgctatccacggtcgcctttaacttaccggcgttaaagaggaccttaacctcactgaccccggcctggtgttcaaccgccgttttaatcttgtctaagcatgacgggcatgacatcccgcccaactccattagtacctttttcatgataaatcccccttttgggcttcagtatagacaggccaactcgaaaaataattgatccccatcaactttgctgaatttttaagagtcgcatcccgttgatgatcacgattaaaatactgagctcgtgaatcaacattcccgaggccatgtggacgtagccggcaaagaggccgccaaagagcagggcaacggtcaaaatggcaatcgcgatgttttggttcatgttggcgaccatcctcttggcaatcgtcagggcgaccggtaacttggctaaatcggaatggagcaatacgacgtcggaaacttctaaggcaacgtcagtcccgttgcccatcgcaattccgacctcggccgtggctagggccgggctgtcgttgaccccgtcgcccagaaaggcgacccggtgaccagctacttggagctccttgatcttttcaaccttctctgccggcatcaggttcccgaccacctgggtcatcccaacttcttttccgacccgttcggcggtggtctggttatcgtcacttagcatgattagattctggtaacccaacgcccgcaacttagtaaaggtcgcctgggcctcgtctttgagcgggtcactaataccaagcaggcccctcaactgaccatcaacggcgaagtaaaccagggagcgtcccgctgcttgccatgccgacgccgtggtggccaccgcagttaagtccacctggtgggtagctaataatttagcgttgccaaccaacaccgtagcccctgccacctgcgccaccatcccctggcccgccagcaccttgctttggtccaccggtaagggggcgaccgcttcgtatttgagcaccgccttggccagcgggtagttagcgaccatctcgacactgactagcaattggtggtcgcgctcgctaacacctgtagcccaccagtcactcaccaccgcgggcaagcccttagtaacggtgccggtcttatcaaagaccagtgtgtcaaccttactcaaagcgctcaaactggcactccccttggtcaacaccccgagcttggcggcccgaccgatcccggcgacggtcgacaccggcaccccaattaccagggccccggggcaaccaagcaccaggacggtgatggctagggcgacgtcgttcgttgccagtccaaccaccagggcaattagcataatcagcggggtgtagtacttggcaaagcgatcaatcacccgctgagccttggacttactgtcttgggcctcttcgactagttcgatgatctggccaaaggtcgtgtcttccccgacccggctaacttcgacaaccagggtgccatccgctaagattgttccggcgctaacggtttggtccaccgccttgggaagcggccgggcctcccccgttaagctggcttcgttcactaagccgtggccccgttttaccaccccgtcgactggtacccggtcgcccgctttcactaagaccaagtcccccgcgtccacgaagtcaatgtccgtaacctccccggtggcgtcgtttacgtcggcgaggacggtggcggtttgcggcgccatgtcggtcaacgacttgacggccacccgggttttctttagggttaacgcctccaagacgtcgccgaggttaaagagccacacgacgatggccgcctcgttgtactcaccaatgatcagggcgccaacgatggccacggccaccaatagttcgatcgagatcacccggtaggtcaaggcgctgaccgcccgtaagaccagtggcacaccccccatgatggcgacgagcaccatcaagagtgagtaggcttgccccaagttagttaaacggctgagttcggcgaagatgattaaccccgtcatcgcccagacgttttgctgttggtggcgattaaaaaatccttgggcttttcccataattatccctcctttgttaccttaaggatatccggtaccacccccatttaaatcgatcggaatcaagagtaacaaaagaagtgcggaacaaccgtaaagcaggctgtggactaagctagggtgaaacgtaaaaaggcggccgacggaaagttcttccgtcagtcgcccgctttagtttaagaataatcgttagttagccaatccccatcgatgaactgtgagtagccatccgtttgtcggggtagagttccttggctaggttggtgattgccgtaggcgcctccccgaagccggtcgcaatcagggccaccttaccttcgtaaacgaccccgtcgccgattgcgtacaccccaggaactgaggtcttcatcgtttggtcgaccttgatttgcccccgttcactcgctaggtccaaagaccagtcctttaaagcggcgttattggaggtgaagccgtagtttaccaagaccttatcaacttcgagtggtcgctcttcgtcagcacgcatcttcttgaggttcaaggtgaccgattgatcggcgttgacggttaagtccttgggcaggtacggggtcaacttttcaatcgttgaggcctccagttgggcaacggtgtgttcaagggcccggaaagcatcgcggcggtgaaccaggtaaacttgctcagccacgtcttctagcatcaaggccatgtcgatggcggcgtccccaccaccgaggacggcaacgcgttggtccttaaagtcttccttgtggttggcaaagtagcgtacctgtttgccctccagttcttcggcgccgggcaaggccagcttgcggggactaaaggcgccgttacccatcgcaattacaatcgacttggaggtcgacgtccgcttggcgctgtgaatggtgaaggagccgtcatcttctttgactacgtcggtgaccttttcgcccaggaattgatcgaccggcgccacttcgatttgggctgctaggtcatccgccagttcctggccagtgaccccagccttaccggccacgtcccaaacccgcttttccgggtagagggcggcgggttggccccccagttggggcagtgcttcgattagttgggcctttagctggtgtaggccgcagtaaaaggcggcgaacatcccggccggacccccaccaataatcgtcacgtcatagcgttcttccatcgtttcttcctcctcgttttggttaccctgccgattataccacgcccgcttttctgaacaattattctgaatgttcggactttcttgattttaatttgtatttatccggtgattcaagtatcattgaaagcgaaatcacaatcctaaattatacgttacggagggttttataatggcacaaaagaaaatgattttggacctggacaccggggtcgatgacgcactagcaattgcttacgcggttgctgcacccgacgttgatttgatcgggatcgtttcttcttacggaaacaacctgctcgacgtctgcgctaaaaacagccttaagttgctagaactgctcggtcagaccgatgttccggtttacaagggtttacctcactccagcaccagcgatcatttcgatgtgatgcaagtttccaaggacatccacggtgacaacggaattggtgacgttgacctgccagaaccaaagcgggccttagaagaaatgtctggggtcgacttctacattgaagccgcccaccaatacggccaagacctgatcatcattccaaccggcccgatgaccaacctggccgccgccctggaaaaggaccccgagattgcccacttgatcggcaacgttaccttcatgggtggggccctgaccgttgaagggaacgtgaccgacgtggccgaagccaacatcaaccaagatgctaaggcagccgacgtggtcttacgaagcgacctaccactgacgatggttggcttggacgtcactttgcggaccctcttaactaagaaggaaacccaacagtggcgcgaactgggcaccaagtccgggattgcctttgctgacatcaccgacttttacatcgatgcctactacaacttagacatcgacaagaacggttgcgccctgcacgacccactggccgtcggggtctccttagacccaacctttgtgaccacgatttccctgttcatgaaggtaatctacgacgaacacaactgcggccgtacgattggggacaaggaccgcttaaacgacccgaacccgaatactaaggtggccgtcgacgtcgacaaggagcgctacttagccaccttcatggacctgttgaccaacttgtttaaggaacactaataggaagtacggaacaaccttctcgacgggccatgggctaagccaggaagtgagcgaaataatgctcacttcctttttcttttgtcctccacaccactctccgttgtcttacgatgttacccgttttcgtcacgccacgttccgtggtcttagtcttttggtaacttttccaccgcttttccacttttccccaaggggttgtggataattacggacttatccccaagatatgggtagccctttttccaacctagtcagagcgctctcgttttttaacaaggcgtggcgccacgaaccgtcctaagcaggcgatcggtaagcattttcttgcccccactaccaaaaacaggtatgatggtcttaaatcatatcttgtctggggtgccattggctgagaaatacccattgaacctgctttggttaggaccaacgaagggaacgacaggtaatcaccgtcaaaaatcagccaccccatgtcccggggtggctttttctttgggcaaggaatggtaaaaatttttggaggaatgtttctcatgaataaatcacgtttcggattgcgcgacgtcatcttacttgccctaatcgggatcatcttcggggtgatctactttgccggcgactttgtttacaacgccgttaccttagccctgacgccaatcggcctgggggcggccggcaacgactttacaatgggcctgtggtgcatggccggaccattagccggtttcatgctcaagcgcccgggatccgcctttttgggcgaatttctcggggcggccggggaaatgtttttaggcggccaatggggggcttcgaacctgatttccggggcggtccaaggggttgcttctgaactcgggttcaccctagttggctaccggatgtacaactggctgacgatcctgtcaacgacggccaccaccaccatcctaacctttgcctgggactggttccgtaacggttacagccacttcgccctgccgatcctcttagcctgctttgtgattcgcttcatctcgatgtttcttttctgcggggtcttggtcaagttgatcactaacctcttggaacgcgcccacgtcatcccgcaagcccaggcctaacccatggaataccgtatccagcacctaaactttgcctaccaagaggaaccggttttagtcgacctaaacctaaccctgccggccggggagctctacctcttttccggcccttctggtagtggaaaatcgaccctcttgcgcattatggccggcctcttaccccggtacggagggaccttaaccggcgaggtaagtggggtcgaaccgggcacggcttccttgatgtttcaggacccgagcctccagtttgccctcgacaccccgcgccacgaggttgagtttgccctggaaaacctggcgcttccggccaaccagatcccggccaaggtggaacaagcgctgaagttttgccaggccgaccacctagccgaccggcgcttagtaaccctgtccggtggtgaacaacagctcgttgcccttgcgatcaccgtggccatggatagccagttgatcctcctggacgaacccttcgcctccctcgatcatgaccaccggacccaattgttggcccgcttagtggagcttaaaaaccagggcaagaccgttatcatcgccgaccacgacttacagggctaccgccagtaccagccgaccgtgatcgcctttgaaaaggggcgctgtcgcttattacaaggcaaagaggcaacggagcgctttgatcaagccgagcaactagctaaaccactcccggcttacttgccaactgaagggaccacgcccctcttttccctggccgacttaaaactaattacgaacggtgcaacactgttaaccatcgaccagctaggcctctttaaagaccgggtcaccctgctaaccggggaatccggtagcggcaaaaccaccctctttcgggccctgaccaagctacgcccctacctaggttcggttacctaccagggccaagaaatcaaacaggccaaggcggccccgtacgcccgccaagtcggcctcgtctttcagcgcgcctctgaccagtacctcaacgtgacggtcaaagaagaactggagcttagccaacaacaggggcaaaacccctactttaccccggaacgggtccaagctgccctgaaaaaactggggctgaccgggatggacgaacgggtcgtttactcgctttccggcggccagcaaaaaaagctccaactgctgttgatgctaatgatgggccaaccggtcttactcctggacgaacccttcgccggcctcgacagtaagtcgattgaagtggtgtgggagctgatcgacgcgagccgccaagtttggccgcaaacgctgatcatcatcagccaccagctagccgggctggccaaccacatcgattaccgcctccacttagccgaccaccacttaacttaccaaggggaggtgcaccatgaatcctagtctgcaactgctgttggttctcctaatttcctttgaggtctcctttaccagccgcttaacggccaacctggtcttcttagtgattgccattttcgtcttattggcccaccgccttcactggcgccagtggctgcggctgctggctggccccttcttaccggccctggccctctttgtgacgatcgttttctatagccccggccacgactggcactttggcttcgtcttagtcagccggatctacctctacgtaatgctaggggcgacggtgacctttaccaccaccccgctcaaattggcccagtccctggaacaaaccgcccacctgccggctaagtttgcttacgggaccttgtcggcggtcaacctcttgcctaagatcaagcaagaagtcatccaaatccgggcggccgctttaatgcgcggcgtcaccctccacctgtggtcacccaccctgtacttcaaggcgatcctggtggcgattaactggtccgaccagctggcccaagcgatcgaatcgcacggctttgtcgaaggtaaacaacgcaccttcgcccaccccatcgccgttcactggtacgactgggtgctcctcggcggcggaattataattttacaggtgctcttaattgcctttccctaggcttttcggtatgctaaaagaaaagttttgggggaggagatttgatgaacgagcagaccttaacaaaccgaatcgtggggggcttaagctacctggcagtccttttcttgccagtcttatttccgctgatcgtttggatcgtggcccggcaagataacccgccgttggcccaccatggtaaggtcgccttttggactcaactggcgcccttcttagtcgtcatagccttgctagtgatcatcgccatcttaaacgcagtggggattagcaccagccaccataccatcaccgggggcgccgcctggttaaacatcctctgggtggttgccctactcgtcggtagtgccgccctctttgcttataacattgtcatggccgtcctcgtcttcttaggtcggcgttaactttttgcgttgttacaaataatgcggaagccacccacccttgcttagaagggagttgtttccgcccatttttagaaaggatgataattcttgtcgacgatttttgggatcttaatgctcctaattgccgtggtggccgccaacgtcttacacctcttgtggccccggctgccactggccatctaccaaattttagccgggattatcttggccctgattcccgttcaatcccacacctttgaactagatcccaaaaccttcctcttgttaatcattgcccccctactctttaacgacgggcagggaacctccccacgcgaactatcgcgtaacctcaaacaaacgctatcaatggcggtcaccttagttgtcttctcggtactggtggtagggactggcttgcacttagcgatggcggagaccttctccttaccgctagccttcatgttgggggcaatcatcgcccccaccgatgcggtcgccgtcaagtcactatcggcaacggtggcgatgcccagaaacgtcaaccggaccttagagcacgaagccctttttaacgatgcatccggcctggtcttgttcggcctggccacctccaccctgtcatcggggcacttttccttagggcaggggatcttcaccttcctctacgtcttcttaggcgggatcatctttggggcgctgatcggtttcctagccatccaattacggacaaccttgatgcggacccacgttgatatcgggcgaattgtgatcccgatcaacctgatgactccaatcgtcacctactggtttgccgaggaactccacttatccgggatcctggccgtggtggccgctgggatcgtccacgccctcttgtacacccgcttgcggttgacctcggctaaggtccaaattgcctccaccacgatctggtcgatggtcgctgacattttaaacgggctggtcttcgtcttcttgggggtcaccttgcccagcgtgctcggtaacacttccctagcgcgcctagccaagattttcgtggtcgccattgccctctacttagtaatgggggcgctacgctacttctggagccaactcaagttcgttgacctccactctaagaaaaagcagcgccaaaaggacagtttcttactctcccttggcggaatccacgggacgatcactttagcgatggccttttcaatcccccacaccatcaacggccaacccctagcggcccgcaacacgataattttgatcgccgccctcgtgatcatcatcagcatcacggtcggggcgctcgcctttccacgcatcctaccggccaaaaagaagagttaccggcaaagcgagttccattatcaacttaacaagaccgtccactacgccatcgaccaactcgccaatgaaccgggcggggcggccgaaaaagcggtggtcttaaacgtgttatccagccaaagcaccctaacctttaagaccaaccaggcccgcttccaaaggatttatgaccgggcccacgaggtcgaactcgccgcgatcaccaagctcagtgaagaaggcaaggtgaccgacaagatcgcccgcctgtacgtcgggttgatctcacgggaactggctagccacggggacgggctgatcaacttctgtcgggggatttactaccggatcaagtggcaccgggtccgccaccgggtttcgcacatgaccccggcccaaaccgcctacttcaagcgcgaggtcgccccgatccagcaacaggtcgcccgcgtctttgacctgatctacccccaagtcatcgcctacctggaggacatccagacccccgccaacacccacgaggtgacgatggtccggcgctcctatttcaaccgccatcgtttcttccgccagcacgagcacctcgacggcgagcaaatcgacatcctcttcgtggcggccttccaatttgaacattcctacatccagcaggcggccgccaaaggtacgatttcggttgaactggccaacgcccttaatgaacacatctccaccgaccagttggtgtacattcaatcgactaactaggaagtgcgacccaacctatcaaacaggccgtgggctaaggataggtcacaggttagcgcgccagcggtgttctgtggccggacttagccactaggcctgtggttggggagcacgttatgggaagtgcgacccaaccgttagccgccattccccttataacatttggtaacccacctaacgaaaaaacgcccccgtggttaaaaccacgacgggcgtttttgattcccgggtaatttcccgagaaatattagggactactgacgcttgcgagggtgcgattactacccaactactcttttttaaaggcaacacggcagtacaccaatggactctagcagttcgtttcacgaacctagctagagtcctattggtgcttgcggaggcacgactaagaaatcagagatttcagtcgtgctctcattcttgccggaccagcaggtcgacaatttcgtccttggtgatcttaccaaagacccgggccaccaagccctcgtcaatcttttggttgatggcttcccggtcgtagcgaacccccaacaaacgttgttcaaagtcgcgcacgtcttcttgacctaagaagtcaccatagaccttgaggtaggcaatcttaccgccctcaatttgcaaacggaagtcgaccgtcccctggtcaaagtgttggcggtgttggatggccgccttgggcgacttgccgtatacgaagtcccagttgctaaagatttccgcattgatcttggccacggcggccttgtcttcatcactcagcacgtattccttggcatcggctaggtcactgacgccgatgatcttcttggctagcatgtcgcggaattcctcgatcgtcaggtgctggtagttcggcgtgaagtggggctttaggtcagttacccggctgtggaccgacttgattcccttggattcaatcttgtccttaggcacattgagggcgtggccaatcacgtcgaggtcgacgtcgtacatcagggtgccatgggagaacatccgcccgtgggtaatccgcatggcgttgccggagaacttcttaccttcgatctgtaagtcgttgcgcccggatagttcagccttggtcgcccccatttcgtgcaggacttcgatcaccgggtcggtgaacttagcgaagttcccgttagagtggccgtcgtctttggtgatgaagctaaaggaaacgttgcccaggtcgtcaaagaccgccccacccccggaggtccggcgggtaacgatgatgttatgttcacgcacgtaatcaaggttgacctcttcataggcgtcctgattgcggccaagaatgatgcaaggcgagttgatgtaaaagtagaggatcggctcatcgagttgggcgtgctccatcaggtaggtttctagcgccaggttatagcgaatgtccctggtatcagtgactaagtacttcatgctctcctcctctaaaatgcgaattgcttaaccaggtgcaccctgacgttttggcttgaaccaacgattttagaaactgggcagcggcgttcgcacttggccaagatctcttgggcctctgcttcagcgacttggggaatccggatctggcagtccaaaaagaactggtagccctcggtatccttgcccatgtcaacgccaaccttaacttcggcggcgtgttctagtccccggcgcccctcttcagcttcgatcgtggcgtgtcaaccaccactgactaaagtcagtggcttgtgagccgaatatcatcacggatttcgaaccacaatttgcgtagatagggacaacttatttgaccaactgaaattgtaatcaaacagcggtcgtctaattaccaacgccttttatgtccccaggttgccatagggacagataagctaggctagtttagctattcccttatcaagaatgtttttagctgcgttccagtcacgaatatggtgaataccacagttaggacaagtccagtttctatcatctaatgttagtttgtccgtcccattagtgcccattacaaagccacaatcgcgacatgtttgggtagtatttcttgggttgattgtgataaattgacgcccataaagctttgctttataagccaacatgccaagaaatgttcgccagccaacgtcagaaatactaagtgctaaagcacgatttttaagcaaattcttgctacgcaactcctcggctactactaaatcgtggttcttgattaatgcggtagaaatttgttggagaaaattatgcctttggttcattactttggcatggagtttagcgactaacaagcgctgtttttgataatttttactatctcgtaaagaacgatgttctttttttgcacgttgttgccgtctagataaaatgcgctgttctttggctaatttgcctttaatagtgcggtaatatcgtggattaggaactatgttgccttcactgtcggttaagaagttatcagtattaagatcaattccaacatgtccatgagtagctttggacactttaacaaaagattcatctgaagctaactgcattgataaaaagaagcgatccgctgaatctttagtcaacgtcacggtaccaattctagtctcgcatattcttttcaaaagccgtgcttgcgaaccggcaacacgtaacagtcctattttaggtactttgacatgactattatctagaaaacagactgtaccgttagttagcaacgcagttttttgccccgggtattgacaattggtttgataccgccagtgataactctttcgatgaaatttgggaacgccagtggcgtgaaccttccgaaaagcattccaagcttttcgatagttctgaatggcattagctttcgtcaaactatcaattcgtttatcttctaagaattgatagtgattagacatttgcttagcgttttggcgcatagttagttgcttaatacgatcctgaactatgtcaatcggtagcttaactctgcgaagctgcatcagttccttattgatcgcaaccatttcgttatagataaagcgactagcgtcactgttgattttaatcaactgcttttgttggtcactaggatagcagcgcatttttaggccataatgatatttcattttcgacattgacttaatttgatttcacctcctttattgatatgataacattatatcatgatgtcaatgtattaacaaaggagagcatattatgactaaagaaaaaatcaaagatgccatttatactcgtcgttatatctataatttccattatcatttgatctgggtaactaagtatcgcaatcagacttttacaaccgaggtcttagctaacgaaatgaaagctatcttgcagcaagttgcggatgacaatgacaaaaaatatacagaaacaaacaaaaagccccataaaggggctcaatagtggcctatccatcccatgactaaagtcacgggatttccggctaatattaattaaacaagtagccagcgctaatcccaggagctattccgggttggtccccgggtcatcctggagcgggctggacgtcaaaacatctaagtcaccgcccagggtcacgcgggcgtggccgtttaaaccggcatcatcaatcacttcggtatggtataaagaacgaaaagtcatcactttgccctctttatgaatgtgtttgcacccattatacgctgaactgactaaaagaaaagggaagtgcgttattggaagtgcgcaccaaccaattggcaggccgtgggccaaggatagggcacaggttagcgcggtacgcggtgttctgtgtccagacttagccactaggtctgcggttggggagcacgttatctgtacaacaaaaagaggttagagaaagattaccctaacctcttaatatgtatgtccttcctctagctaagaggaagggtgaacaactatgctacatcaagtggctaatcttgattatggtagctagccatcgtgtgtttacaactgcaccttagcgtatcaagtagggcttagcaactatttaatatacttctccaaaaagtccttcacgtgctcttggtaagccgctggggcggtcgcaaaggacttagcatgaacggctcccttgaccaaccacagttccttgggacccctagtcgcggcgtagttttggtagaccatcgcggttgggacaaaggtgtccttggtaccgtgaatgaagagcatcgggcgatggttgtggtgtagggacttcaccgaactagcctggccgatgaaaaagccgttggcaacccggttgatcccactcatcgtcttgatcagcggccaggcgacaaataccggcaagccgtacaggtccttagcttcgtgcatcagttcggcgttaacgctggtgtagccacagtcttcaatgaaggccttgacctggctaggcaacttgatgcccgacgtcatcatcgtcgtggcgccccccattgagaccccgaacatcacgatctgactatcggcgccgttttctttaatcagacggttaatccacttacgttcgtcgtagcgttccggccagccgtaaccgatgtatttcccctggctatcgccgtgggcccgggcgtccgggatcaagacgttgtagcccagctggtggaacatcgcggcgtaggcccccatcgaatccttgttattcatgtaaccgtgggcgatcaggaccgacttattggtcttcttggccgccggaatgtaatcggcgtccagcttcaggttgtcggtcgccgacttcatcgtccaaacctgcttaggggtcttttggaaccacatcttctgggcgtaaagcgggtcggacttttcaatcttggtattgttgttaataaaggacttgtgccccgccaccattgcgacgttaaagaaatacagggccacccctaaaaaggcgaccactaagagggtcactaagccaccgaccacccagggccagcggcggcgtttgttgctcgttttttgcatcgttttctcctcaatttcaatcgtttcattttaccacgctgtgtgggtaatcgtcatttgcttttctaagaccacgggacgtggcgtgaatggtataataaaactgaattgaggaaggaagtgtcgatatgtttccagaacgactccgggccttgcgcgccggacaaaaaattaccctccaagaactagccgacgccctaagcaagaacttagccccgggtgaaaagcctaactccccctcccaaatcgggaactgggagcgggggatccggaccccgtcttacgttgaggtccgcaagctagccgagtactttaacgtcagcctcgactacttgaccgggcgctccgaccacgacgaaaccgatttggccaagctcttttttgataccaacaaggccctgaccttcaaccagcggaccctaaccggcgaggaccgctacgaaatcttccaactgattgacggctactttaagggccaggccaatcgtcgcgaaaccgccactttctatgcccaacaagaagaactgaacttaaactttaaggacgaatcatgaaccccaaaaaactccgccaactcaaaaaagctactaaaaaggcccggaccacggccccagctccctacattgcacaactaacccgctaccgggacctatttgacaaggtaccccaggtcaagtacctgctcaacgccgccttgttagacgaccagttgttaaagtctgggctcttgccccagccgttgccgaagttgctcttgcccgatgacatccaaaccgtcatcttcaaccagcttgcggctaagtacccccagggcgacgcaaccggcgaccgcttgtgggaccagtacacggccgccctgcccaaggttgacgccctcttgcgcgactaccgcgactacctagaggaaacctacggaatgtggtcctttaccaacgtctcctttatcagcagcctgagtgattatttaaagggcgcaccggtcttggaagtgatggccggcaacggttatttgtccaagggcttaaaggacaaacgcccgacccaaacggtgttcaccaccgattccacggcctgggtcaaggagaaccaaaccgggcgccatccggtcatttcaattgaacccttagacgcgctcgccgccgtcgacaagtacgccgaccaggttgaatacgtgatcatgtcgtgggccccagacaagggcgaggccgactgggacttgttagaacatttgcgggaacactaccccgccctcaagctcctcgtgattggggaaaaggacggcgccaccaattccaagcgtttctggcaagaagcccagctctcccaagacggcctagcccaggttaacgccgctctaaagtcctttgacctgattgatgaacaggtttatttagctaaataaagaagtgcgatccaactcctagtaagcatcttactatcttcacgaatgttggacagaaaacgtgggaaataaccgcaggttatttcccactcagcaatataaaaacgccacccgcttctccgtggagaagtaggtggcgttttcgtttggcaaacgtggcttggcggccacgtggatgtgtattgatactatctcaggtcgcaccggtcgtccactaccagctggaccaggcaccctacaatccggtaggttacgtgccccactcgagaatcatttccgttcgcacgggggaaccaaataagggtcggttccctgacctctcgactcatcgcagtctttaccataccacgattttaagcttccggcaaggctaatcgtcctcttcttgggcgccccggttttgggtcaaggcgctgagctggttaaccagccactcacctagcggggtcacaaaactgtttggctggtcgctaacggcgtcggcgtcccccagttcatcgatccgcaggccggattggttaagctgttcgccctcaacgatcatgtaaaccttcaccgggtaaggctggtcccgttctaagagcttggggtctaagcgctgtgcttcggccatcggcacgttgatcaggttcatttctaggcgcacgctgactgggtcaccaaccggcactttgacctcccagttgtactggcttaagtgtccggtcgcgatttgctcggccatatccattaaaccggcctttagggtggttgcttgctggacaacggcggcgctcacttgccccgtggtgacgtgtacccgttcgctctctaattcccccaggtattgttcgtaggtcatttccattgcttgttacttcccttctaagcgcgagtaggtgtagttgagccgctggcgaattccttggataatcccggccaccgccacgacgattccgcagatggccaccagttggatcaacaggccggacatggcggagcggtcgtgcacttgcaggagccccccgaggttaataatccccaagtagaggttaaccagaatcgtgacgtaactagacaggcggacccgcaaggccacgaagattaccaccaggacggctagggccaccaaaaagcccacccggcctaagacggccgctgaattccaggcttggccaacctgggcgtacatacaaaactcaatcaccgccgccagaaccatggcaataatggtgtaggcgatgatcttattcgcgttcgttgtttttttcattttgttccccttttgctaatcttcccctattctaactgatcaacctgtaaagctcaattttcctcccgccccgggtagcgtataatataggtgaaagcatgaatggaggaattgttatgacaaacggaacttaccaacgtatcttagtccccatcgacggctcccgggcgaccccggtcgtcatggaaaaggcgattgccgccgccaaaaagcaccaggcccacttagacatcctaaacgtcgcccaggttaaccagctgaccgacggctacgcgattgccagttcgctgagcaccagccaaaccttcgacctggttaaaacgacccaggagcggctgggcgacttaaagaagcacgccgaagaaagcggggttaaatcggtcgctatccacatccgctttggcaaccccaagcaggtgatcgcccgcgactttatcgccgaccaccacaacgatttaatcgtgattggtaccaccggcctgtcgatggtcgaacgcctgattgtcggctcggtcactagttacgtggtccgtaacgccgcttgcgacgtggaggtcgtacgggtttaggttttgaatgaaaggacggcgcccctatggtttcgcatcaactgacaatttcccttgacgaagatgcctttcgggcccttgaaaagagggcgcaaagcgaacgacgcccactagaagaggtggcggcttccatgctgaccaccgctagcaaggtcccggcgaccgggatgaccagtttagaggggcgcttcgtggttggccaaatcgtcaccccatctgctttcgaccccaccgagccactcgtcttggtgcgggggatttactaccgctaccggattgtgggcaagccacaacccggccaacgtttcgtggtcaccacagtcaaagataacgtcttaaccctcacccccaccaacgaaagcgaggatgatgcctgatgtttttctcccttgtaatcgtatttatcatcttctttctcctttacggctacttcgccgctaaaagcgaggccaagaaaaaaccggataacccaacggcgccagccaagcaaaacactaaccgccccgtcgccaccggagtttcccaccgcagtgccaaacacacaggaggttttagcatgttcggaattgccatcgtcaagcaaaacacccaggggctgattgaaaccttagggaagtactcccggactgtcgaagccggtttacacctgtacattcccctggttcaacacgtccgccacgttagcttggccatgcagcccatcttattgcaaaagtacagcgtcatcaccagcgataacgccgacgtacaggcctcggtttcgttaaactaccacgtcaccgacgccgttaagtacagctacgaaaacaccaactccgaggagtcgatgatccaactggtccgcggccacttgcgcgacatcatcggccggctggaattaaaccaggccctcggttcgacttccaacatcaacgcccagctggccgctgcgatcggcgatttaaccggcctgtacggaatcaacgttgaccgggtcaacattgatgaactgaccccgtcaccggagatccaaaaggcgatggacaagcagctgaccgccgaccgggaacgggtagccacgatcgcccgggccgaaggggaagcccgcaacatcaagctgaccaccgacgctaaaaacgccgccctggtcgaaaccgcgcaggcccaagccacggcgacgcggaccaaggccgacgccgaagcctaccggattgaaaagattcgccaggccctgagtagtgttgacgacaagtacttccgcgaccaaagcctactggccttctctaagctggcggagggcaacaacaatttagtggtgatggataaagacgacatcaccgaactaggtaaggtcccggtcgctaaggaattgtgggacgccggcaaaaacaaataaagcaagaaattactcctagagataaaacagccacccaattcgccaagttacgaattgggtggctgtttcatttagaggaggttgggtcgcacttccataacgtgctccccaccacggggctagtgtctaagctggccgaagaacgatgcgtaccgcatcaaccgttcgtcccagcttagccatacgccccgtcgaggaggttgggtcgcacttcctaatttccgttagccgcgttggccttggcttccatttgcatgatcttgcgttccttgaagaccaggtaaaccaagagcaagaaggcagcggcggccgccacgtaaatcgtcgtcgccgaagcgccccaaccaaagtggtcaaccagttgaccgatcagggccgtcgcggccgtttcaccgaagacgtattggaagaagcccatgaacccggtcgacagcccaacggcgtagttcggcacggcttcgttgaccattagtcccactaaggacagtggggcgtaaatcaggctccccataatgaagaggactaccgtgattacggcttgactggtgctagtaaagtaagtgatcaggcaggcaatcaaaccaatcacgcagatgaaacaaactaaggaacggcgccccttcaagaagtcggagaccaaccctaagatgattacccctggcacggccgaaagttcaaagatcccgactaaccacttggcccagtcggcggagaagcccttggtcggcaggtaacttgggatccaactcatgaccccgtaacggacaatgtaaattgacattgacgtcaaagtaacggcccaaaccaccttgttagtcaagatgtcttggaagaggatctgggtgaaggacttttgggaaagttcttgggaggtagcttcccccttttcgtccagttccacgtaaccagagtattccgccatgtttggcagccctactgcttctggccgttccgagttaataagcaacattaaggttgcgataatagctgagataacggaagcggtcaagaaaaccatcgttaaagaacctgagaagagcagggtggccatttgaatcacggccacgcaggcaaaggccccggcgttgtgggcagaggcccagatggagaacatcgtcccccggttcttcttagcgaaccagagcgagatttcacgttggcaggccacggcccccatggcttgggtcacggccactaagatcatcaggaataagatgatgtaaaagttcttggtgaagcccaagaaggcgttgaaaatacaagataggtacagcccggaagccaagaaccacttggtgttggacttatcggctaagccccccatgaatagcttggccaccccgtaaccaatcccaaaggttgataaaatcagcccaatttgaccgattgaaaagccatacgcctccatgatcggcttttgttcagtggtaaaaatcagccgaatgatgtagtaggacaggtaggtaacacaagtggcgactaagacccccgcctgacgcttgcggtattcgccggcgaccttttctttaggcaccagtttcgttgcgtccggtgacggctttaagaagttaaacatctaatcactcctattctgtttgatgtccccaccagcagaatagttacgagagggccgaattaaaccagtgctcatctatgtatttcccgggaaattaccccggggtcataaattggacggttaaccgagttatctacgaacttgatctgcgagtggtagcgctttcgccaaccgtattatatatgacttatagaccatttacaacatagtttattgaatcacaggtgttttgacggctaggtaattcgttttatttaaatgcttatactcccgaaaaatgtgttccggcgtgaatcccagggctttaacgacttcggccccctgcccgctaataccaaaccggtcaacgcccataacttttccgtttaagccgacgtatttgtaccacgactgactggcacccatctcgacagcgagccgccgggttacttgtggcggtaagaccgcatctcggtacgccttcggttgctcatcgaaaaggttggtgcttggcatcgaaacgacccggacgtcaatcccgtcatcgaaaaggagctcgcgggcttgtaaggctagggcgacttccgaaccggccgcaatgataatgccgtccggcacctcacgactcgaatccgccaacacgtaacccccccgctcgaccggtgcgtccaccgtttcttctagcaccggtaagctttggcgtgacgccactaacaacgacgggcggtcggtcgtccgtaccatcacccgccaggccgcggccgtttcgttagcgtcagcggggcgaataacgttgaggttcggcatcgcccggaagctagccagctgctctaccggctggtgggtcggcccgtcctcccccacggcgatcgagtcgtgggtaccgataaagatcgacggcaggtgcatcagtgccgcttggcggatggcggcccgcaggtagtcagtgaagactaaaaaggtgctcccaaaggcccgggtccccccgtggaggttgatcccgttgacggccgcggccatcccaaactcgcggacgccaaagaagatgttcttgccggccggggtgtccttaccaaaggtgccaccgccgtccaagaaggtcttgttcgagctagccaggtcggccgccccaccccagaactgcgggttggcgccggccaccgtttgcaagacctccgcactagcttgacgagtcgccaccttctcccccggtttacgggtggtcgctacccccgtcacacttaattgcgggttagtcaactggcgggcttcctttgggtactgagcccggtaggtggcaaagagggcttgccagttgtcgtaggctgcccgcttattagccaccgcggttttgaagcgttggcggatcgccggggcaatttcaaagggcgccgctgaccaggaatagaagtcagccatcgcttgacgcccctcttcccccaggggagcgccgtgcaccttgtttgtgccgccattcggggccccgtaaccaatcgtggtcttaacttcgatcatggttggctgcgtgctttgctgggcctgcttgatcgccgcttcaatcgcatccagatcggcgttgccatcgtcaaccaccaggtactgccaaccagctgccgttaagcgttggcgtgggtcctcgtggctactcaagcttagcgggccatctaaggaaacctggttggagtcgtacaagacgatcagcttgcccagccctaattgaccggccaggttgattgcttcctggctgagcccctccatcaagtcgccgtcaccggccagaacgtaggtgtagtggtcgatcagcggcaggcccggccggttgtagacggcggccaaatgcttttcggccattgccaacccaaccgccatccctagcccctgggagagcgggcccgtcgaggcatccacccctggggtccagccgtattcggggtgaccgggagtcttggagccgagttggcgaaaagccttcaagtcggcgagcgacaggtcaaacccgttgaggtacaagaggctgtataacaacgccgagccgtgccccgccgagaggataaaacggtcgcggttaagccactctgggtcgcgggggttaaagttcatcacccgttcccacagggtgtaggccatcggggcggcgtcaatggcaatcccggggtgaccgctgttagcttggttaatcatatcgacgctcaaaaagcgtagggcgttaaccgccagcatttcttctcgttgcattcttccccctccttacttaaccgggtcagcgacgtcatcgaggatgctaaagcccagtgcctggatgtcttcttcaaaaccacgcaccgtgtctaaggcgacgtcggccggcgtcatgtcccggcgcgatagccacttttgtaggatcgtcggtggtaccgtgatgatgtctaagccggattgttcggcctggcggatgttatcaacttcccgggtcgacgcccagagcaacttcacgttggggtagcggtatgacattgccgagctgcaaatcacaaaggaagtcgggtcaaccccggtgtcggcgacccgcccaacgaagagggacacaatcgcgggcacctcgggatcgagggcgtctaaggcccagcgcacctgttccttggtcgtgatcgccgttacgttaagcttgatcccctggttggagagttcacgcaacaggttgatattgggttgcccatctaaggataagatcggtaccttgacgtagacgttgggccccaaagaggacaggatcgtggcctcttctttaatctgatccgggtcctgggtgaagacctcaaaggaaaccggcatcgacgggaactcggcaaccacctgcttggcaaaggccaggtagttggttaccccagcccgcttcatcaaggacgggttggtggtaaagccagtcacttccggtaacttggccatttcacgcatgtcattaatgtcggccccgtcggcgtaaatttcaatcgttgcttggttcgtaaattgcataactaaatcgctccttttaagagtataccaatttcacatcattaagttcgtcatgcttcatatcatgcacgtctcacccaactgggtcaacaacctttttgtaaatcggagcggttaatttgttaagaccaattatgtttaattcgcttatatcaaccgatttagcgatgaaataaagctaatttaacgccgatttaattggatagaccattttgaaataagggcgtcgctttttcagccaagcggttgcgcaaatttaatgaccgttgcaatatacatgaagtgtttttcatttatattataaaaatatcagttagaccaatcttaatcaggatactaaaaaaggcagggagaaaacacggtcttcttcctgccttttcctataattcccacaccatcagttaatttttaggtccgctaagtcacgacggaggtctgctaagccaatttggcccggcgccgaggtttttcccacggcggcaaaggtcaaggccgaaccgaaggcctggccactaactcgactaaccttgccaagatcgcccatcgacatagtgatgatcggcaggttcaacttagccttggcttccaccgtagcggccagaactgtcaggacgtcggcaggcgactgcggcatcgaggccaccttggctacatcggccccgaggtcggccatcgccgtcaaccgggcaacttgctccgcttggctcggcgtctgttcaaagtcgtgattgctcatgaccaccttgaccccgtttttatgggcggtggtaagcacgcccttgacggccacttggtcgtgttccaactcaacgtcgactaagtcccccagctggtgtttggctacgaacttaagcagggcgaagtattggtcgtcggcaaggtccattgcgcccccctcacccttagttcggaaggtaatcagcaagactatttcaccaatcacttggcgcagtgtggcggccgtttgagctaacttctcttcatttaagacgtcttggtaaaagtcaatccgccattcgattacgtccggctccatggccgctacctttttagcttgagcaatcagggcgtctcggtcggtatcaaccagcgggacggcgactttcgggaggccactccctaaggtaatgttgcgaacggttaatgttttcatactagtcttcatccttaaagagcagatcgcgaatgtaatcaaccggcatttcctgaccggtccacagcttgaaggcttcagccccttgttccagcatcatcccgagcccgttgaagacgtgttcgacaccagcgcctttagcgatcttcatcagcttggtttcgcgcggggcgtagaccgtgtcaaagacgatcatgtccttgtggaaccaggacgggtcattgactaaggacaagtcagctaattcgcccatcccgactgaagtggcgtcacagtagatgtcacagctagctatcgattgcttaaagacgtcttggtccgtaagcgggtgtagtgtcgccttgcagtcagtttccttgttaatgatgtcaacgttcttcttggcttgttcccactgcgggtcggtgtcccggttgaagatgtcgatttcagccaccccgtccaaagcggcttggatggctaccggcgtcccggccccaccggccccggcgatcgtcatcttcttgccgataatgtttaagttttcgtcttctagggacttcatgaagccggtcccgtcggtggtgtacccggtcagaaccccattgtcgttaacgaccgtgttaacggcgccggtcatccgtgaagctggggagagcttgtctaggtacggtaggatcttttgcttgttaggcatcgaaatgttagagccgcgcatgtcgagggtccgaatggcgtcaacggccttttctagcttatcgttgtcgatttcaaaggccaagtaggcgtagttgagtcccaacttggcaaaggcgttattgtgcatcgtcggtgacattgagtggcgaatcgggtaggccatcaaaccgatcagtaaggtgtgtccgtcaattctttccatggtaagttcctcctaaactgttaaaaactaacaactaaactaatcccgcgcggcgctggtcccggcgacaaagcccgaggcaaagctccacgagttcatcatgctaggcatcgagtcgtgaccgttagcgccccccacgacttcaccggccccatacaggtgggcaacgggctggttatccttgttcaacaggtgcatcgactcgtcggccatgtaaccccccagcgaggtggcaaagcggtcccgttgttcgatcaagtaaaaggtgtcgccctcaaattggtgcaggaattctggtgcgcgcctgaattcggggtcgtttccctgggcaacatagccttggtaagcggcaacggtcttagccaacccggctgggtcaacccccgccttttgggcgacttcttgcaggttccccttgaccacgattggccgtttcttgccgtcattagctaggtaactcgcaatttcttgcgcggagaagtcgtgtaagacaaggagcttgtaaacctcatcccaggtccgcttgtccatcaagagatagaccacccgccctggttgctttaagacctggttacgtaacttggtgtagacgtcagattcgttgacgatccgttgcccattttggttgacgtagagcgcccccatgtcggtcgccaatttggaagcgtaggtggtcagcttggcgatccccggttcaacctccagcccgtgggggtataccttgtaccaatcgaggtcgtgagcctttaggtggaggcccttggcgaaggtgtaggagtccccggttgccgtcagcggcccgtagtaatcaaccccttcgttccagccctcgttgtaggccttggccccgtaaccaccagaggccaaaatcacactcttggcgtagatcttagccttaccatccttgccttcgcaccacagtccggtcaacgtcccgtccgcgtcttggaggagaccttcgacccggcagtcggttaaaatggtgccgccctttctttcaaaggccgacgctaccttagtgatgaactcgtagctacttgacgatggtagttcaatttggcgctggaccgagtgttccggcgtttgggtctgggccttttggtagtccaggtcggcaaagtcggcaatgaaatcaatggcggcaccgatattgttagccaagagccgcgacagctctgggtagttggtgtgctcacactcgcgggcaatatcgtcaactaagcgctccgggctgtcctggtccgccccggcgccaaagatctccttagcggtctcggaaccggtggccgtcacgttagagccatttaaaagggtcgcgccccccaggtagccgtttttttcaaccaaaatcacctgtttgcccaggctcagggcccggcaagcggccatcagcccggcgcccccagagccaaccactaagacgtcggtggttagggtgcgctcctttttagctggccttacgggagccgggaagtcgtaaccccgttctgtaaccactttatcggcggagtccaggatcgactgggtcatctggctggccccggcaatggcgtcaattttaaaggattgttcctctaaaatagtgtcctttaacttgccaaacacctgcttaaagatggccggcgtttcggcgtgtcggtcgaccgaaatgtcgttgatctttcggtcctcaacatcaacggttaaatcaatttcaccgttatgtccaaaggccttaacgggatacttactcatgcaaaagtcctccttgttacaaagtgatacgttacatctttcacgatcattgtaagcactccttacccggaaaactaattgaggaattcgattcgtttgattgaaaaaatctatcaaaaaaggggttggaagaaaccgtggttttctcccaaccccttactatcttcaggaacgttagttaactcacgtgctcccaaccaccggcctaatgtaagtacaggccaagaacaccgctagggcgccaaccgtttgccctagcttagcctaacggtccgtcgaggaggctagtcgcacttttacttaaataaacttctgctttttgacgtaattgatgaacttctgggcggccgggttttggtagtgctcctttaagaccgccatgtatacgaagcggtgccactgggggtaggcaatcggaatcttggccaggtctaagcgatccatgttatcgagttgtggtaccaccccgatgccaaaccccgccgacaccaaccccgctacctctacgtcttcggaaaccgaataggaagacattggcgaacgtccgcacagggcgtagaggttactgagctcattggcaagaccggtgttggaggcgtaggtaatgtgggggtaagcaaaggtatcttgcaggttaaccgacttgagcttggcgagcgggtgatccttgggggtaatcaggtagagtttttgttccaagaccgggtagtagtcgacgtcgttttggttatcgacctttgagcaaaagcaaatgtcgtattgttcgttgcgcagcccttcgataatggcttgggaaaaccccggggtcggggcgaattcaaagcggattggatcgtccgcggttgccgccaagaagtcccgtaacaggtggggtaagaagtggcttcccaagatccgaagcgacgagatccggacccgaaaaccttcttgttccacctggtggatccgctcgatcgcccggtttaacccctcgacgacctggtcactttcctgaacgaagagccggccattagcggtcaacctaacgttgcggccgaccttttcaaacagggcgatcccaagttgactctccaaggtcttaatcgcgtaggaaagggttggttgggtgatattcagcatcttggcggcctgcgtatagttctcagtttgtgcaaggacgctcaaatagtgtagttgatccaaattcatagaaaaacaccatccttttcgggcttaacgccggtctatctatagaaattttaaattttttctatcaagaaatcaattagactttaatattggaagcgctttataatttgacttgtaaaacaattactaaaaagatcacaattcggagggtttaaacatgagtaaaacacatccaattaccgttagttcctggaccttgggtgaccagtgttcctttgctgaccgttgccacgccgccgcagaggccggctacgatggtattggtctgcgggccgaaacctacgtcgatgccttaaacgagggcttaaccgaccaagacatcttagacatcctggccgaaaacaaccttcgctgcactgaagtcgaatacatcgttcagtggtgtgaagaaccccgctcctacgaacaaaagtacaaggaacaagcttgcttccacatgtgcgacctcttcggcgttgaacacatcaacaccgggttaatggaagattattccgttgattacacggctaagaagctccaagaactcgccaagcgggccggcaagtacatcatcaccttagagccgatgccatacagtgggatgaacgacttgaagaagacctgggcgatcctccaaaaggcggactgcgacaacgtcatgatgcttttggacacctggcactggttccgggccggccaaccttacgacctgttgactaaggaacaggccaagcgggtgatttccattcaattggatgacgcttacgaacgcccctacgccgaatcaattctgcgtgacgaatcgatgcacgaccggctagcacccaacaccggggccgccgacaccgaagccttcatcaaaatgatcaaagaggccggcgtggacccgaaggtgatcggggtcgaagtcatctccgatcagtacatggctaaagggatcgactgggtcgctaagtacacctatgatcacacgaaagaggccctgcaaaacgcctggccagaaatcttaacggactaaaaggaggaactctcaaatgactgactggttgaacttaaaggatcaagtggttgtcgttaccggggccgttgggggcatgggaaccaagttcaccgaggacttcgctgcccaaggtgccaacgtggtgttaatggacctcaacgaagaaaagctcacttcttgggctaaggaactggccgaccgttacggggtcaagaccctgccgatcgtcgccaactcgaccaaagaagacgaggttaacgccgccgtcgaccaggtagttgctacctttggtaaggttgacatcctagttaacaccgccgccatcctccgcttctccccgttagaagacctgtccgttgacgaatggcggaccgccgttgacattaacctgaccggctacttcatcacctcccaggcctttggcaagcagatgattaagcaaaagtccgggaacatggttcacatctccaccgtggccgccatcttccctgaaacttactccggcgcctactcctccaccaaggctggcgtctcgatgctatccaagcaaatcgccgctgaatggggccaattcggggttcgtagcaactgcgttctcccctgcctggttgaaacgccaatgtcacacgccttttacaccgatccagaggtacaaaaggggcgttcccgcctggttgctagcaagcggattggccagttagatgacatttccaacgccgttttgtacctggccagcgaccgctccgattacaccaacggggccgaactcaaggtcgacggtggcctgagcatcatgatgcaagacatgatccctaagccgggtggccggcgccaatacgccattgatcaccaccaaaagtaagccgcaatcaacctacgaccgatcgactaaaggtcatcttttccaatgaggtatctaagaaatgaaaaagcaaagctacgccggtgttgccaccgcagtttacgtcaactacgccatcgtgggaatggccaccatctttatctcccagtacagcacctacttccaaagtgcttggcacaccaacgtgaaaggaatctcgttagtcctcgccgccgttgggttaggccggctgctgaccatcttcttagccggctccgtttccgataagattggtcggcgcaagaccatgttaatctccatggtttccgacgtcatcttcttactcggggcggccctagcccacaacatgattgtagcggcgattgccgcaatcttctttggctttaccaattcgtttggggacacctcctgttatccggccctgaccgatgcctttccgacccgatcggcaacgatgaactccttagttaaggcctttatgtccctagcccagtttctcttccccttttgggtttccaccgtcactaatgccctaatcacggcgctaagcctctccgtcttcttagttttagacatcctctttgtctgcaaggttcagtttgcctcccaagacaaacaaggacagctcaaggacagctcaaggacatccaagatgccgaacacattgaggaaacggtgaccagtgttcaaccagccatggccatcgacggcacccttttaattgcgatgggctttacgatctgctttaccttctacgttttctcccagtacttaccgaacttcgggaccagtgtcttgaaggtcagcccggaacaagccaaaaccctggtctccttttacgccatggcctcaatgatctccgtcttcgtgacggctgccttagtcaccaaggttaagcacctgctgttgatcagcatctacggcacggtggccgccctggctctcttcatgatgatcctggtgccgtctctaacgaccgcccggattggtagcgtggcgatcggcttctttgccgccgggggaatttggcaagtcggactctccattttgaccagctacttccccactgggaacggaaagctaacctcttattactcctttatggcttcgttgacctactttgtcggacccctagtttctagttttgtgatcagcgattcggcagctagcgtcttagcggtcttttggattacggcgatcatcgccgccgctacgatcgtgattgccatctggctgttggtccgcagccagcgctaccacttcgaataactttgctataaaaagcccgccccagtaattgccggagcgggcttttggtgtcattttatcgcgcgtgtagaacttccgggccgtcttggcgaccaacgattacttcgttgacccgatccaagaagagaccgtgttcaacaacgcccacggtgtgaataaggtcctcagctagggtcttcggagcatcaatcttccccatcttgaggtcgataatgtagttcttttcgtcagtcaggtaacggttatccccgtccatccgccactgcggttgatagcccttcttttcaaacttgcggaaaacgtgggccgccccaaacgggattacttctactggtaccccaaagtcgccaagcttatcaactaactttgattcgtcaacaatccaaatgttcttggttgaggcatcgtttacgaccttttcccacagcaaggcgccgccgccccccttaataccttggaaatcgtcgctcacttcatcggcaccatcaatggtaaggtcaatgtgatcaacttcatcaatatctttgatcgtgatccccagttcagttgcttgcttggttgtccgacgtgaagtagtcaccccaacgatcttcaaaccttcgtttttaactcgttcacctagggcatccaccatgaagcgaacggttgacccggtccccaacccaacgatcataccatcttcaacgtacttaacggcttcttttccaacgagtgcttttaattcattttgatccataactatatcatctccaatgtttagttttacattaaaaaagaccggaaaccccggccttttttacaagtctaagaatgcgagtcattccgatccgctcattacttccaggttcgctattgatcattactgtaaggtgttgtaaggagagtaactaatgatcactgctcacacggttttaactggccggtaacttggtaatcacagtgacttcgcatccttgagacaacgaaattaactatcaaccgtggattggtattaatggatttggttttatcctagctgacagttaattttgatcttcccacattttgttgaaaacgtcaacaacgtgatcaacagtgaagccgtagtccgcgaccacttccggtcccttcccactcttaccaaaggtgtcgacgccgacaactcgaccgtcaaggcccacaaattggtaccaagcttgcgtgttccccatttcaaccgccagtcggtgacgaacaccagtcggtaagactttctcttggtaatcagcggattgttccttaaagcgttcaatacttggtacggaaaccacttgaatgtcgtagtcgccttgcttttgaagctttgctttaacttctagggctaaggaaacttcggacccagacgctaacaagatcccatctggttcttgcgtcttggccggtgaaatgatgtaggcacccttttcaacgtcggcgcccttcgtttcatctaacaccggcaatttttgccgtgatgcgatcaaaacacttggcttatccgtcgtcttagcaatcaccttccaagcttccactgtttcgtgcgcatcagccgggcgaaagacctgaacgtttggaattgtccgtaacattgccaactgctcgattggttcgtgggtgggaccgtcttcaccaacggctaaggagtcgtgagtaaagatgaagattgatggtaagtgttgaatggcagccaagcgaatggcagccttaaggtagtcactaaagaccataaaggtacttacgtaagcacggctccccccgcgaaggttaatcccgttagttgcggttgcggccccgaactcacggaccccgtagtagacgttgcggccggcgtagttatcgggcgtaaagttgccatcgtcctttaaggccgtcttgtttgaggaggccaggtcagccgctccaccccagaactgtgggtttgccttggcaagttattgcaagacgtcggaactggcaacccgggttgcaatttgatcaccagtttggtattcgtcaaccaagtcggttacgtctaacatgttagaagaacgtgaatagctactccatttggactagattcttgattcgacgcttataactggactcccacttagcactgaaagccgccaatcgttctttggcggcttgtaggttctctacttgccgaatagccttaaagtcggtgataatctccctgcgatcgtttttgcgaacgtaccctaaaaggttgcgctctgcgtggacccagcaccgttgaaacttcgcctgcgggtagttagcctcaatcgcagattgaagtccaactaaaccgtcggcgatgaacaactgaatatctttaatcccccgtgcacgtaatccctggagtagttcagaccaagcggctccgttctcggtcggtgcgatactgtagtcaagaacttccttaccgccgtcacttcgaattccgatcgctacgttaacggcttctcgttcaacggtaccacggcgtaacggaatgtaagtagcatcgaggaacacacagacgtactgtgagtacttgaatttgcgctcgtggaactcttcaaccaggtgttccgtccgcttagtgatgtttgaaaccgtggttggtgagtagtagtggccgtacattctctcaaccatatcagcgatttcacgagttgtgacgcccttggagtacatcttgatgaccatttcctccagtccatcagtccgacgcacgtaaggagggaagagggcgttttgaaacttgtttaaccggtcccgtgggatcgtcagattaatttcaccgtactcagtgtcgatcgtgcgggtgtacgtcccgttccggtagttcacgtcgtcttttgatcggtcgatccgagtatgtggttcgtagcctagcaccgcagtcagttcattttgaaggaactgattagcggccacttcgatttgacgacgtaagacttcattcagggtaatatctttgtctgaagatagcgctgcgataatatctttgttaaactggttcatggggaaagtctccgtattctgattggtttttagcgatttcaatcatacggggagggctttccctttttcaataccctcaaggtatcaatttacacaaaatattttacactcccctttccacgactcacatcaatacctaaaacgtgcactttatcgccttccatatatttttgaggtaacaacttcgcagattcgttcattttctaaattcgatctcagggacccatatcctaaatctaactgttcactacgtgttgttgggccagtttgacactcggaatgtatattccactgatgttgacgacctcaacctcaatttaagtatagtaaaagaggtatcaagattgtcgtcacaatcttgatacctcttactttaggatgtttgacaaacttccaaaaaacgccactcggtcttaacttaccgagtagcgtcttccagttctattcttctagtttatgcgttttacgatgccaacccaagtaggctgcggcccacacgatcagcagtagggcgaccagataataacccacctgaccgaattccaagtttcccagccatagccacatcccactggctttcttcatgaggctgacgcccacttggagcaattcgatgctgccaatcataaaggcggcaatgaccgaaatcgcggtaacggtcaagttataatgtcgtttgcgttccggtgtggcaaatgcccactggtaagcaccagtcatcataacagagtccgtggtatccatgaggttcattccggcagcgaagagcagcggaaaggcagccacgccccaacccgccgtttgcgcatggcctgccgagagggcaatcaaggcaatctccgtggccgtatcaaagccgaggccaaaaagaaagccaattggatacatttgccagctatgattaatcaagcggaggagtggcgctaaaattcgcgttaggaagccccgttgttgtaagagctcgtccgtggtggtagccgattgacgagttgttcgatacaagttgataaagattaacaagttcgcaaaagctaagattaacaaaaagctcccagataccaagccaccgattcgaccacccagactttctaaaatcggtaggtgttgcttaactaaagacatcgagatgctgacgactaagattaagagacacactaccgtggaatggcccagcgagaagtaaaagcccactcccgttgcgggttggcgctgattcaccagcttgcgaacggtattgtcaatggcggcaatgtgatcggcgtcaaaggcgtgacggaggcccagtgtgtaagccagtaagccgagtccccagaaagttggttgttggctagcggcgagccacagacaaagaaacgcgatggcatgtagcaaaaaggagagaagatagtagggaaacgctgcggtaaagatcagcttttccattgaaagaaacgtcctttctaaaaacaaaaagcaggttgcctgataaagccgggcgacttactttttcaaaaataacgagttagagcttattggaagacgccctgatagaggacggctgccgcaatcgcaccagcaattggcgcgacgattggcacccagctatacccaaattgggagctgcctttatgctcaaatggccaaatggcgtggagtaaccgtgggccaatatctctggcgggattcaacgctggaccagttggtcccccaaaggaaatgactaaacacatgactaagaagcctaagccgataaaatccgcccgtggatcaagtttatctgccgtcatactgatggcccccaacacaagtaaaaaggttccaataaattcgttaatgaacccatttaacttgctgtcagcggcatcaatcgtggaaaaggttcccaggatggcttctgcgtcggttgttttgtcgtagtaaggcttgtaagccaataccaaagtgagttgaccaatgatggcccccaagacttgcgccacgatgtagggcgctacttcgccccaagggaaattacccgtaacggccatagccagcgtcatggcaggattaatttgcgcacccgatacggtggcaaacattaaggcggggatcatgaccccaataccgtagccaaagccaattaagacccaaccaccgtgataacctttggtaccctttaattcaacgttagcgacggaaccgttacccaaggcaaccatgatagccgtcccaataaattctgcgatacaacgaaccaataaagaataatgcatgtaaattctaccccactaaaactttctccttttgtgctaccgaaagcgtttgattcatccgaccactggagaacccttgtaaatcaacagtaatatactcataccccaactgacgcaagttttcagaaactttttcattttgagcaactaattgtgaaagttggttaactgggacttcaatacgggcaatttgatcgtggacccgaacccgaacggtagcaaagcctaagctgcgtaaataagtttcagcggccatgacgcgttggagcttttcactcgttaagtctgtgttgtatgggaagcgggaagaaacagagcaagaggccactttgttccaattagttagccctaagctttgagccaattcgcgaacctcgcgtttatagaggtcggctgtttgaagtggggagacggcaccggcttcgtcacgtgcacgcagaccgggccggaagtcagcattatcatccataatcatgccatctaatacggcatcagcattgaattgggtcgctacttgtgtcatggcttggtagaacatctgcttcatggcgtaccaagattcaggggtattgtgcttgatctgatcattagccaagtagtctaattgaataccggtaacttgtgcgcccatgtccttggctagttgaccagccatttcgtattctgcatctaagaagagttcggagttggcaacgactgcgaggacattatcgtggcctaaaacatctaaagcctctttcaaaacaacggttgagtcaattccgccagagaaaccgactacgacccggttgtaagtttttaaggtattttgtaaagttgtttctttatcagctaaagtcatcataattgattatcctttctgttccatagtggtaagttcatttaaaatcttggcctgtaagtcagccatagtcagctgatgagtggttgccaattgtcgcaaatcatcatgttctaaggtacgcttggttgtgttatggtagcgcagatatttgacatgaatcggtccgtagctagtcgtgactaacttaacctggcgatccatgatggcacggtgaacgtggtggtaacgaattccgatcgctggggtggttgttagcagataggtcacaatggcggcttgttgttggggagtaatcaaacaacaaagtttgtaagccgggcgaccttttttcatgacaatgggttcactccaagcatcctttgcgccgcgatctaacagtcccgcaatcgtatcggctagttgttggccggtgatatcgtcaaggttagttgctaacagcgtgacgtgatcctgttcttgattgaccgtttgctggcttaactgggaatttaccagtgtggcccgtaacgcatttaggctgccagtctcacgtttaccaaaaccgtagccggtccgttcaataacgccgtcactggtcgtgtcaaaggccgtggcacagcatttgacaatggccatgccggtgggggtaatcagctccgtatgcacatcgaaacgttgatgaatcggaatggcagttccaatccgcatctgcatgacagccggtactgggacgggaacggtgccgtgagcaatctcgatggtaccgctcccgtcagccagattattcacaataacgcggtcaatgcccatcagttccaaggcaatcgccgcgccgaccatatcgacgatggaatcaatagcgcccacctcatgaaagtgaacgtcttctaaagacttatggtgaacgtggccttcagcaattgcgacctgttcaaacagcgcagtggcccgccgcttaacggtgggggctaatgtactttgcgcaatgagttgcttgattgttgcaaagctccggccgtgatggtgaccatgttctgtaatgccattgtctttaacctggtggtcgtctaagatgacatcgaagtcagtgccttgaatgcttgagcgactactaggggtgacggtcaaatggtaaccggtcactggtagtttcttcaattcggtttcaaagtctgtttgagataatccgagatcaaatagcgcccctaggaacatgtcaccactgatgcccgaaaaagcatctaacactaatgttttcatggctgctcctccttcacgagatgattaatcatactggcattgtaagccgcgccgaagccattatcgatgttaacgacactgataccggccgaacagctattgagcattgacaaaagtggtgtgagaccgttcagatgggtgccataaccgacactggttggcacggcaatcactggccgatcgactaggccaccgacgacactagttaaagcgccctccatgccggcgatgacgatcacaacgttggcttggcgaatgaggggtaatttggcaaataaccgatgaattccggctacgccaacatcatagacgcgtgttacctggttgccgaaaagttctgcagtcacagcagcttcttcagccactcgcatgtcggaagtaccggccgtgacaatggcaatatttccgaccgcaggtaaggcgtgggcagttcggactaacgtctgtgaggtttggtcataggccaattcaggtagtatttcttggaccgccgctgatttttcaagatcgactcgtgtcacgaggatgggttgttggcgtttctccatagcttgaacaatgcccacaatctgttgcgcggttttaccagcgccatagatcacttcaggataaccagttcgttgcgtccgcgccgtatcaatcttggcgtaggctaggtcatcaaacccggtatcgctgacctgtttggcagcttgttctggtgtgagttggtggttagcaacttgttggagacaagttaataaatcagttgatgccattattactcatcctttacgattacgccaagaccatcgggaatgaccgtcacttgggccgcaggtccttcacggttgaaggcgctggcgagtgcgtcatcgattgaggttgccagttccatatgcatatttgtgatgagactgggttcaaccaagtcagaaaccacaatcacgtggtggttaaccaagatccgggccagaatttgtgaagtccattggtcaggcaccgtttctaagcgcggtgtgttaatcgccttatccaagaattcttggggatcggcgacgtcagcaatgttgtgataaaagccgtcaccaccatgaccatcacgacagccagctacgatgataatcgtcccgttttgcttattggtggcttcagcggccgtcatgcctttaactgcttgatagatattttgatcgagtggataaccaccattagtggtgatggcaatgtcgctcttgatggccttaacaccagctaactcaccaacaaaatccgttccttgtttatgagccgcttcaaggtcaccggcaaaggagccaatgatgtgcttgtcttcatccaaaaccacgttcaaaataaactgtaaaccagcttttctggcggcgtagaccatatcatggtgcaccatgttgtggtgaagattcccggttcgagagtgcttgtcgttgataaactcaccggagtggttagccatgattgtcttgtaagaagaaatacccggcaagacggacttgcgcccaccagagaacccagcgaaaaagtgggattcaatgaagccttcggagatcaatagatcggcttcttcggccaccttgttgataatgaggtcaccgccagaaggaagcttaccaattttcaccatgtcttcatcaactttagatttatgcataacaatttcttcattggccacaatctcttcgccatatttggcgactaattcggcatgcgttgaaggtcggtggaatccagttgctacgagaatgcgaatccgcgcctctggtgctactgagcgcaagcgccgaagtaagattggcgtaatgatgtgtgaaggaacgggccgggtgtgatcagagctgataatcacaatatttttctttcccgtagccaattcttctagggaaggactaccgatagggttgtctaacgactgttcaaccaagtctttttcagagaggctggcttgataggtcgccgctttggagaccaagatgccggctaggttggcatcgttgatgtgtgccgtgaccgatccgtggtcataagggagcttaatgtctgccataatctaatcaatcttctttcttttaaaggtacagttagcaattataaacgtttcattttcgttttcattgacaatcctcactatgaaagtgaataatcggatatcaataaccagtgtcattgccaaatgttaatgcgaaggggtatcctttttcactaagataggactttgctaacgataattaattttggaaggagtaccgcttttgccgaataaagatattgatgatctggtccgcttcttaaaggacaaacagatttcgacgattacgaagaagtatcacagttatttaacattccacggtctgaaggccgctaatgtctttattttgaaagaaggcatcattaagacgtccgttatcttgcaagacggacgtgaatttaacatttcttatatcaaccaacctgacgttatttcactgttacatgacgaagctttgcaatatgatgagcaaccttttaacgtccgcattgaatcggagacggcaaccttttatcaggttaatcgggtagaattttggcagtacgtgaatgccaattcagagttacagaactacgttaaacagtattatcgacaccgattatcagaaacctttgcccggattcaacgactcaccatgaacggtaagatgggggcactggctaatttcttacatgacattgctgagaagtttggtcgggatcttcccgatggggccggcgtgttgattgactttaacgtgacgaatgaagatattgctgggttctgtggcattgctaatcaaaccagtgttagccgtatgatgcgtaaacttaagcttgaagatatcattgactttggcatgagcaatgatcgtaaacgccgaattatcattaccaatatgaaaaaattagacgactacattgcctattaattttgggtctagaatttttggtgttggaaagtatttccattccaaaagtactaggccctttttgataacggcgaattgtcaaactaagtgcaacggtttgtcaaaaaatacttcatatggggtttcatagtttaacactttgcgaggacgttgatttaactgctttcggcagtgttcaacgtcctgttctgtataattatcaatatctgttcgcttgggaaaatattcccggattaatccatttgtattctcatttgttccacgctgttcaggcgaatatggatcgggccaatagacagtaacacctaacctttcgctgatttcatcaagatgaagaaattcggtcccatgatctggtgtaatagaatgaacaaattctttaggaatggcccctaacagttcaactaagcctttatttatctcctgcgagtccttttgcacaacctttttgataagcgtaagccgactaagccgatcgacaaccgttaaaaggatggagtgacccgttcgaccaatcacagtatcaatttcccagtcacctatacgttgacgctggttgataaaaccagggcgctcatggatcgagatatagtcggtctgtacttctcgatgtcgtctagtattctttgaatgccgggtccgatgtttatgtctgagatggcgctgaataccggtatcaccacgtgaggagtacttttcacctaaattgtgttgatagatatgacggtaaattgtgttgtagctaacacaccattgatgttccttattaaagcgagcggtaatctgctctggtgaccagtgcagatctaagatgtaatgaacaatttgacggcgtaattgtggatggctgtctaatagccgcttcttgtgacaattctgccgcttttgattatagtcattatctgctttgcttggggaataattacctgcacaacgttttaactcccgtgaaatagtgcttagatttcgccccagccgtaacgcgacagcccggatagataaccccttagctcgtaaaaacataagtatttcacgttcttttatagtaagatgtttatagctcataccggatacctcgaattgtttgatttggtcgttaaacatattctacccggtatgggtttatttttttactttgtgttgcatttcaattgtaaattcgccccactattaaagcattatcaaactcagctgcccacgactgacattctggttcgtggtgatagtggcttcgccacgccagaagtttacgatgtctgtgaagccaacgatgtgttttacattattcgactcaaacgcaatcgaaaattacagaatctagctgaaaagttcgtcaagatcagtgatcaaacccagtggcaagaggaagagactcattactactctgaaatctatcaatcagcatcgtggcctaagccacggcagatttatattaaatcaactcgagtagctagtgaactgatcttttcacatgaatttatcgtcactaatctgactaatttaacggctgaaactgccttcgaactgtatcacaaacgcaaccaaatggaaaattacatcaaagaagctaaaacaggtttctttttcgataagactgatggttcaacgtttaatgccaatgctgccccgatgatggttagtgtactggcttacaatattgtcaactttttaaagcagctagcactgacaaaacatgattccggcttgtgcgttagcacattgcggatccgtttattcaaagttgcggcacgtgttgtgcatactggccgacgaattcagttgcggctgagctcgtatcatgtttaccatcggctgtcctaccaggctctacagcgtatccaggctattgaataaccggcaaaattaaaaaaatctgtacaaccaagggacaagtgtatccaaaagttcaaagcaattctgagttagttgaaagatctcactagctagaactgataaacatcgtatttcagcaaaagataaagacatacccgtcagttttcgaaaaaatacgaaaactgacgggatttttatgaactatgaataattcaggtgtatataaaaactgctaactctacctattgttaggtaaaattagcagttttagttagtgtttaattaattggttcaattttttagcccaacttgctcttcacgaagtcttgaacttcttcaacagtggcgtagttggcgatgatttcgtcaacgtagccggcccattccttggtgtcgagcttcttcatcatgctccgggtacggaggatggaagtagcggacatggagtattcatccaggcccatccccatcaagagtggcagtgccatttcgtcaccggccatttccccacacatggcggccttagcgccgttttcgtgagcggaggtgatgacgtgcttaactagggataagaaggctgggttcagcggttggtaaaggtaggaaacggcttcgttcccacggtcagcggcgaagctgtattggatcaaatcgttggtcccaatggagaagaagtccacttccttagccagttgagcggcgtttaaagcggccagcgggatttcaatcatcatcccgatcttaacgtcgtcgcccagacctgggtgatccttttgaacttcagccttggcttcttcaaagatcgccttggcttgacgaagttcggccaccgtcgcgatcattgggaacatgattgaaacaggtccgaattcagaggcgcgcaccagggcccgtaattgggtcttgaagagttctggccggtccaagcagatccggatggcccggtagcccaagaatgggttttcttcctttggcagtggcatgtaatcgagcggcttgtccccaccgatgtccatcgtccgaaccacgactggcttaccattcatgcccactacggccttcttgtaagcttcaaactgttcgtcttcgcttggcatgtggtcgttgtccatgtacaagaattcgctccggaagagacccaccccgtcagcaccttgcttaacggcgtcttccgtgtcatccggcgtcccgatgttggccgcaatttcaaattccttgccgtccttagaaacggatggggcatcgactaacttagcccattctgcccgttcagcttcgaaggctttggccttagcttcatattccttcacttggtcgtcactcgggtcaatgatggcgtccccgttcaaaccatccacgatcatcatttgaccgtgttcaacggaagtcgtgatttcgttagaaccaacgatggctggaatccgtaaggtccgggacatgatggcggcgtggctcgtccggccccccaggtcggttacgatccccttgacgaacttagcgtccatctgagaagtatcggacggggtaatttcgtgggccacgatcaccaccgggctgttgatgccggcgatgtttggtaattgcttacccaacaggtggctcattgcccgctttgcaacgtccttaacgtcggcagcccgttcttgcatgtaggcgttatcggtcatggcggccaacatgtcagcaaaggcggtcgttaccttgtcaacggcttcttcggcaccggtgtggttgttttcgatgtcatccttaatttggcccagcatttccgggtcagataagatggcgatgtgagcgtcaaacacgcccagctcttcttccccaaggcgatccttagcgttctccttgatttgcgtcaattcttcaattgagtcttggaaggctttttcaacccgagcgtattccgccaccgtgtcatcaacctttaccttgtcgtaggacagatctgggtcaaccaacaggtatgccggggcaatcccgatcccatcactagctgcaattcccttcacgtcttttgccattatatgttcctcctaaatctgagtgtcaaccgtgtgacactgctcaatacgtctaattataaaccgttatcattgtgaattctaccgtatattaagcggttgcatgtaaccggttcaacacgttgttatcctataaaaacaggctgattctgcaagagaatcaccctgttttttgtaaatggcgaatttacaattgaaatgcaacacaaagtaaaaaaataaacccataccgggtagaatatgtttaacgaccaaattaaacaattcgaggtatccggtatgagctataaacatcttactataaaagaacgtgaaatacttatgtttttacgagctaaggggttatctatccgggctgtcgcgttacggctggggcgaaatccaagcactatttcacgggagttaaaacgttgtgcaggtaattattccccaagcaaagcagataatgactatcatcaaaagcggcagaattgtcacaagaagcggctattagacagccatccacaattacgccgtcaaattgttcattacatcttagatctgcactggtcaccagagcagattaccgctcgctttaataaggaacatcaatggtgtgttagctacaacacaatttaccgtcatatctatcaacacaatttaggtgaaaagtactcctcacgtggtgataccggtattcagcgccatctcagacataaacatcggacccggcattcaaagaatactagacgacatcgagaagtacagaccgactatatctcgatccatgagcgccctggttttatcaaccagcgtcaacgtataggtgactgggaaattgatactgtgattggtcgaacgggtcactccatccttttaacggttgtcgatcggcttagtcggcttacgcttatcaaaaaggttatgcaaaaggactcgcaggagataaataaaggcttagttgaactgttaggggccattcctaaagaatttgttcattctattacaccagatcatgggaccgaatttcttcatcttgatgaaatcagcgaaaggttaggtattactgtctattggcccgatccatattcgcctgaacagcgtggaacaaatgagaatacaaatggattaatccgggaatattttcccaagcgaacagatattgataattatacagaacaggacgttgaacactgccaaaagcagttaaatcaacgtcctcgcaaagtgttaaactatgaaaccccatatgaagtattttttgacaaaccgttgcacttagtttgacaattcgccatttataattaagccttttgagcttccttcttagcaatcttgtgttcagaaaggaagaaccacaggatcagggcaaaaccaattgccggaacgatgaaggagaattgcatggaaccagtcaggtcagaaacacgacccatgataaccggaagggctgccccaccaacgagggacataaccatcagggcaccaccagtttcggtgtgttgcttttcttcgatctggtccaacccgtgagcgtaaaccgttgggtaaactgggccgaagaagaaactagtcgcaacggcaccccagattgccaatggtgagtgaattgagcaagtcagcagaagaacaatcgtccctaatacacagtaccaaatcatcgtcttggtaatggagtaacggttcatgaaccagttggcaaagagcttcccaacaaaccataccatgtagctaatgatcatgtagttagttgcggcatggtcagaaatccccggaacaatccgcagtgccaaacgaatggtgaaggaccatacacaggtctggatcccaacgtaaaggaattgggccccaaccgccttcatgaagcgccagttgtggaacaggtagtttaaggattcacccatacttggttggttagcagtcttagcgtccgccttcgccttcccgtatggcatcttcgtaattgctaccaatactaacaggatcaacagaacaaacaagatgtacttgtacggacgaagcgtcagggcaaggacttccttgtttagtgccatcttttgtgtagcgttcaaaccagcagactcattttgcaagttactgtgaccgctaaagatcaggtacttccctaagatgatccccatggcatccccgaacggaatcaaagtttgggagatgttaatccgccggttggcaaactcacgcggccccatcatcgttgagtaagtgtcacaagaagtttccaaaaaactcaaaccaatggcgataacgaagatggccgctaagaacatcccgtaggttgccatgtgagaagccgggaagaacagcgcacaaccaataatgaagaatgtcaaaccggtcataatagctgtcttgtacgtgttcttccgaataatgtatgacgcaggaagggcgatcaagaagtacccaccgtaaaaggccgattgaacgaaggcagttgccgtatcgctcaacgtaaagaccgtcttgaactgcgtgatcaaaatatcgttaagtgacgctgccatcccccacattgggaagatcaacgaaactaaaatgtattgccaaaccggcgtcttgctgaggtagccgtcgtcatattgaacccacgactgcttctttaagttatccatgtccttactcctccttagaaggttaccccggactcaagaatgatgtttgagtacggcgtcatctcacccgtccgaataaatgcatgcgtcttagctaagttcttcttcaaatccgtgtgtggcataaactcaatttcaacatctggcagtgcctgcttgatgttttctaattgttctgggttttggtccttgatttcatctgctaagtagatcttttgaaccttcatttccttcagaacgttttccaagatttgcatgaacgtaggcaattccttgtctacgcacaggtcaatcttcttcgtccccatcggaactggcatcccggcatcaccaattgataaccagtccatgtgtcccatgccagcaacgacagatgctacttctgaatttaaaattccactcttcttcatgactaataacctccaaaacaactctacttcaatgcttcttgaacttggtcaaacgttgggattgatggcattgcccccatcccttgaaccgtcaaactcgatgcgcgctgagcgtaggtaatggcgtctgccaagttcgagaagtccggtaacaattgtgaaattaacgccccaataaaagtatcccctgctgcggtagtatcaattgcctttaccttgaaggctggtaccgttccggaaccatccttagttgagtagtaggccccctttgaacctagggttactagggttacgccaacacctttggcacggaagtactcagcagtttgatccagtgatgcatcatccgtgatctcaatcccagtcagcaaagcactttccgtttcgttaggagcaatgatgtccgtgtattccagcaactccggcaggatttccgttgccggtgctggattcaaaactgtaataacaccatttgccttcgccatcttaaatgcttctaaggcaacagtctgtggtgtttcaaattgggtgatcaaaaagtcgaccttcttcatcacttcctcgctcttactaagaacgtccttagtcatcgcttggttagccccaccataaaccatgatgtcattttggccattttcatctagagtaactagcgcagtccccgtaccgtggcgcgggtcattccccacgttcgtcgtgtcaatgtgatcttcttgtaaggcatcacgcatgaacttcccttcggagtctgcgccaaccattccaatgaagtacgtctctgacccagaacggactgcagcgactgcttggttcgctcccttaccaccaggcgctgaactcttatccgttgcagctagcgtttcaccaggttctgggaaacggtgaacgtgataagtcgtatcaacattgatgcttccaagaacagcaactttgtttgacatataatttcctcctgttacaacgcatccacgtaaaacgttttgttaaaaccttttacgtaccaatcgacccgtttagtttatcatcgcaagaaagcggttgcaacaaaaatagtgtttttaaagtcctggttatcactcgttatgcaagcgtttgctaaataatttattcacaaatacctatcattacaacaatcaaaataaaaaaagaattttagcaaaagcactaaaattctttttaattttttacatctctatgagttgttttgcatcttctaaatcggtaattaactcgcttgcgtacccaccaactaaggcggcgtgaagtgctgctagcttcgtactcccgcccgccacgaggattgaatggcgtttcaattttaactgctcaatgggcagcgccattgtttgcttcgataattgcggatcagccacttggcctttacgatcaatgaattgggaaattgcatcaccaaccgcatgttgctttaaataggcaatctgctccgcagttaaataccccaattgaaacagcattgcatcatccctcgttgttccaaccgtaaagagggcaatctcagcagtagccgctgtttccatgatttggtgaataaaccggtcccttaaaacagcatcccgggtctcttggttatcaaagatgacaggaaccggaagaattaaggtttgggtgctaaaagcttggttgaatttttcggcaatgtagctggcgtagttatttcgcgatgaatttgcgaccgtccccttcagatataccgtttgaacatcttttttattacttggttgcaagtaatctgccacggcagccattgtcctcccccaacttaacccaattgtgtcaccatcttggacaatttcttggaggtagtttgccgttgcttgccccagttgttcaagaatctggggatatgattcacccacttggtcaacaacaattgcccttttcaaaccgtacttggttcgtaaatcctgctctaaactaccaacgttttcaaaagggtcctggattcgaatatcaaccattcccgtatcaacggcatactgtaagtacctagaaaccgttggtcgggagatttctaaattttttgcaatatcagtttgactaactttatctagatagtaagagcgagcaatccgtagtgccagcttgagttgtgtttccgttaatttttcacttcgcatcaccattcaaccctccttgtcgttttcatatttccattttaattatttacaattgcaaaaacaataaatataatgaaagcgtattcaaataaaaagggagctagaaataatggaatttaataactacattgaccacacccttctcgccccagaggcaactgaagagcaaattgaacgcatcgtcaaagaggcgatggacaataactttcacacggtaatgattaacccctactgggttgaaaaagtccacctacttctgaagggttcttctgtcaaaacggcttgtgtaattggattccccctcggggccaacaccaccaaaatcaaggttgctgaagctacagatgccattgagaatggtgctgatgagttggacatggtcatgaacatcggcgaaatgaaatctggtcacttggataaagtagagcaggatatccaagcagtcgttgatgtctgccaccaaaataagcgtgttattaaagtcatcatcgaaacttgtctcctaactgatgacgaaattgaagcggccgccaagatcgttgctaagacgggggctgactttgttaaaacctcgactggtttctccacccaaggcgccaccgtccacgctgtcgagattatggcccaagcggtcaaggggacttccacggccgttaaagcctctggcggtatccacacccctgaggacgcccaagcaatgattgatgcgggtgctacccgtttaggagtcagtcacagtcttgccatcatcggcaaagcataggaggagtcttaacatgaagaaatttaacctgagccatgaaatgttttccgccgctacgtttgacctttacgaagacgacaactttaaggtatcaaccttcaagtacccctctggtgttgaagctctgaaggtgtccaacagccggggttacctcactctcttaccgttctatggtttgatggtttgggacgctgtttttgatggcatcaccttgaaggaaaaagatggtttcagtcagccacttttcggtaagcagatctctgacacttacggcgcctttgaatttacctccggcttactggcaaacgggaaccccagccccgaggataaccacgttcaacacggggagtttgcaacggcacgcatggatcacgcagcactagttgttgatgatgataccatcactgttactagcgattacgagtacatcaagggttttggtgaccactacctagccaccccatcagttacgatgcgcaaggacagcggcctctttgatattgagcagcacgtcaagaacctgtctaactgtgccccaatgaccttgcaatacatgtgtcacctttgctacgcctacgttgataacgcaacaatgacgtccaacattcctgatgaagccttccagctacggacctccgtcccggcccacgttcacccaactccagaatggatggccttcactaaggaattagaggagagtggcaagttaattgacaagctcgatgacccaagtcactacgatccagaaatcgtcttcttctcctccgacttaactaaatacactgacaccgcagaattccgggttgaccttggaaatggtcataacttcttaaccacttacaagaccgccgagctaccaatcgttacccgttggattctttataacggtgatcaacaagtcaacgcttttgccctaccaggaacttgcaccccggaaggccaattagccgctaaaaacgccggcactcttatcacactcaagccgcaagaagaacgtcacttccacgttgttactggtttagaaaactaaccacctcgcttgttttaaaaaggagtgaagaacatgacccacgatattactgtaattggctccaacatgatggaattaacgaccgatattgaccgcatgcctaagttaggggaaactgttagcgccccaagttttcacatggcctttgggggaaagggggctaaccaagcttacgccgccgctcaactaggctcctcagtggccatgatttcaaaggtgggctccgacagtcttggtcaagcctacttggaacacttccaacagagcggcattgacattacgggcgttagcgtcggtaaccaaagtaatggagtggcgccatgcttcatccaaggcaatatgaacagtatcatcgtggttcaaggggctaacagtgagttaacgccagacgttcttgatcaatacaccgatctcatcaaaagctccaaaatggttatcttgcaacaagagatttcgctggcaacggactaccgagccattgacctagctgaacaattccatgttccggtgatgctaaacccagctcccgcgaatgataacgttgacttagaacacatcaccaagtgcgagttttactctccaaacgaaacggaactcggtcgtctcacccacctgccggtagaatctatcgaccaaattaaagacgctgcccattcccttgttgaccaaggggttaaaaacgtaatcgtcacaatcggaagtcgaggagcactctgggtttgtgcggatcatgaagatctcatcccctcttacaaagtcaatgccgttgactccatcggggctggcgactcattcgtgggggcctttgcccactactacacgaatggtgaagacatcccaactgccttaaggcacgccaacgcctacgccgccgttaccgtaacgatgtccggaagccaaacctcgtacccatccgcagccgaattacctcagctacaagagcaactgggcatcaccgtcgacccgactcaacttgcttaactgaaacaaaagaccagtggttcaaatctgcaaaccactggtttttttgtgtcataatcttattttgcattcttttccgccatccggttcaaataagaccaaatttgtggtcgatactggcgaagcccatacaacgctaccaagtagataacgatacacagcccaatccaaaccggattctgggaaataaaggccgcgaatataagggcgtttaccggccgggcaattagattgaagctagtaatcaagactaccccggctggaatcgccaccccatagtgagaaaccgtaccggtgtagatagttcctaaccaactggaggcgtacagccccaatgagaaccaaacaattccgttggcaatcacctttaaaatattgccacgagtaacggcgacgatcgattcaaccatgaagggcaacgatattaaatcaactaccggtagagtccgattccccggtaagatgaaggcgattaccaccataatcggtattagaatcaccccggcaatgattgtagctggctccccgtaaccaaccccatcatcaacaccaaggaaccaccgttttttatcgtgaatagcatcgatttcttttccttgctcagccacttcctttttgcgattcttgtcaatctcttcagccaatggcacgaaggctttggcaaagactccggtcaccagcgggaaaattgtcattacggcagctagctgcacggcaaactggaggatttgtccccacgctttgatagttcctaaactatggagattccctaggataccgataattaaccctaacaacgcccctaaggtcgtcggttccccaaacacgcctaacttattcttaaagtattccggagtcaccttaaccttattgaagccgagtaggttccacagtggatccaaaagaattgccgggatggtctgctcaatgttatgcggggccgccaccgtagcgtttttgaccccatagtaatctgaccatcgatctgcctgaacttccgccaacactaaggaatacaggagcataaaaaaggacaaccccatcgacaaccaaaagttgtgggtaacatagtaggccatcgtcccccaaatcatgaaaccaaagttgttccataagttagaggccataaagactttagtgattcccaaggcaaagatcagcaattcaaacagaagcccgaacacaaagaaagccaggcctacagttgacccaaagctagctagagacccggcttgccagccaatgtcgaccaccgggagtttaattccggtagtactcaccatctgcttaataatcttagtgaccaccggtgtgaattctgaaatgatccaaccaaaacccgtcagccccaccccggcgtaaagggcgctcatcattgccattttgggttgaacctttaagaaaagggcgatgataaaaatcatcaccgggacgacaacgctagccccaaacgccgtaaaaaaggcattgacatcttgaaacatattttccaccccatctgctagtgtacattgaaaataaatacataaatccctcgataaatcattagtgctaatgttattctaactctagaagaaagcgtttcccaaccaaaagccgttattttaccggataagacgctaactaatttaacatatttaattcaactctctaaattttatgcactcgagggggcagcatcgtggaaaaactaacaattaacgacattgccaaactagcgggggtttcaacggccaccgtctccaactttctaaaccacaattacggcaagatgtctgccaaaactcgtgcccacgtggctaaaattatcactgaacataactaccaccccaatagcgtcgcccgcgatctcgcaaaaaacgacaataaaacaatcggggtttcaattgctgacatcaccaatcccttctccgccaccgtcccttctggaatctcggcggtttttaatcaagcgggttaccggatgatcctcaccaatgctgataatgatcaggataccgaaactagcaatatcctacggctccaagctcaaaacgtggctggtatcatcattgatccagttaatcccgacaatccaatttaccagactctctccaataacgacatcgtgatgtttgaccgccagatggagactctaacctttgattccgtcgccaccaataatacggaggcagttgaagaaatgaccaagcggatgatgattgcaggctacgacgaactctactttgtctcttggccactagaaaaggtcagtacccgtatcaaacggtaccaaggctttttacgtaccatacgttaccctgacggtacccatctaattccggtcccttaccctggtcaatcagaatcgctagtaactttccaaacccaaatcaaacggatcatggagcagcgcgggaataagaaagtgggtttctttacgatgaacgctagcgtctttgtccaactactgcaaaccatgcaacacaacaactacacctccccgaccgattacggggtcgccacctacgaagagtttgactggatgaccgtcatgcgtcccgggatctcttgcatccgtcaggactcccggcgaattggaaccgacgccgcgaaactcttgaaaaagaagttggaaactaaagaaggtggcgttccaaccacccacatcattccaacgaccctgattattcgcgatagcttttgatggaagtgcgaaccaacctcctcaacaggccgttgagctaagctagggcaggggttaatgcggttaaacatcgttctctgcccgtacttagccactaggcctgtggttaagaccgcgtaatcttgcgtaaattttcagatttgtcctgtcctcatttttcgcgccagtataacacccaggtattttccgttggagtccattcaaacctaacccaaaaaccagaccaatcaacatctgatcggtctggcacggcaattgatttagttagtaaacatggcggggttggctgccacgctcttattcattcgggtcaacgttgtggcgacgggctgaaatttggtaaaagaccagtgccacgatagcaaagaagaacggtccagcgatcgtccaaaaggcggtctggtagtcgtgttccagtagtggttgaacgaaggtaaagagaatcccgacgatcaggataatttccaccaccacgactaaaatattggtccacaaaaggttcttaaagaccacgaacgggtagtccaggttcttctttttgaaaaacgggaacgccccgaccaagaagaggtacgggaagcaagtggaaacgttggccatgtcggtcaaaatcgtgtaaaagccctgagcggcattacccccgaaggccactaagaagacgattacgcacacgacgatcgcctgtagccacatggcgttagcgggcatcccagccttatttagcctggtcaacttagctggccaaagcttcggggcggaccccaggataaaggccttaattggcgagtacattaggataaacagggcacctaagaagccgaccgtctgagcgatcgccacgatccgggtcatcgttaccccaaagcctaaggccgcggcgtgcgaccagccgagggcggtccccatttcaaccccaatatcattgaaaatggcgtaggtaacgttccccaggttggtggcgttggtccccaggttatcgtggtagttaaccgaccagccgaccatgaagatcatcaaaacgtaggcgccgatcgtaaagaccgaagcaatgatcaacccacgcggaaaggtcttttgcgggttatccatgctgtcggttaccgaccccagcgattccatccccccgtaagcgaagatggcgtaaaccacgaaggaaacaatggcgatcggggtttggaactgcgggttgggcgaagtgataaaggtcttgaggccatgaatcggttcggccaactggaagtggttggcaaacaagacggtgaaggacaccacgatgaagataatgttaacggcaattgtgaagatcccaccgagcgacccgatccgggcgatcacgttcatcccccgcgacgataagaaggtgatcgccaggattaaaatgatccccaagatcccgatcgtttccgtcgacgagaggcccatcacccgccaagactgggtggtgtcctttccaaagatcagggccgagaaggtaatccagatccgcgaggacgtcgaaaccatccacacgatccaggacgccagccaaacgaaggtcccgacaaaggcccaccgttccccaatcgaaccggccagccaggagtaaatcccccccttagcttccttaaaggcggacccgtactcggccatcattaagccgcacgggaagaagaacaagatcccggccaaagcgtaccagatgatactgccgtaccccatctgcaagtaggcgttggacacattcccaaagccaaagatggcggtgatgatcatcgtaaccagcccgaaggtcgtaatcttcttgctggaaccattgttatccatcaaaatatcctccaatcgattttaaaaaataaacatatacccctattatagtcctatttgactagatttaaacgaataattatgcatttatgattgagtgcgacccaaccattgggcaggccgtgggctaaggatagggcacaggttagcgcgccagcggtgttctatggccagacttagccactaggcctgcggttggggagcacgttatctttggaagtgcggaccaaccattggcaggccgtgggctaaggataggctacaggttagcgcgtcagcggtgttctatggccagacttagccactaggcctgcggttggggagcgcgttatctttggaagtgcggaccaaccattggcaggccgtgggctaaggatagggcacaggttagcgcgccagcggtgttctatggccagacttagccactaggcctgcggttggggagcacattatcaagaagtatgacctaaccttctcgacaggctgtatgactaagcgaggtacgttatctgtgtaatagtgaaaaagaccatcccgaggcggaatggtctttttcacattttttacactgttaagtacattaagcgtgtgcgtggggcgccgttggatgcgagttagtgttagatgtggcggagacggtggacgtagctaccggcttgtagccctcttcggtcagtaccttgacgtacaggcggcgccaagaaatgacgcaccaaacacaaaaataaatgtccagcagagtagcaagaccgttcccaaaactacccaataagaacatcaagacaagtcctactacccaaacgtaaagcgtgtatttgaagatttcaccaaagaggcggggtgttttataacgggacgtacacaaagcataaatccaagtaaagatcgctaagtaggttggtccgtcgtacttatcctcttttacgtcaccggcagcgttgaccatcttaatgtcgtccttgttgctttcgaagttaaccagttccttgaggtcctctttaacattaattttcatggtgttctcccccttttccctgcgttagtccagatccccaatccttaattgacctaacacataaaatagtgactttaaactactaaaacaccttttgataattttatttatcttacttctaagataaaattaataataaaagtttcaacccctctacattaaataatcaaaattattattttgttttgcgtagtatttcattttgaaaacaaaaaaagaccaccccgaggcgggatggtctttttcacattttttacaatgctgttaagtcaatcgttgttacttgaggcccttccaagtccaagcttcaacttctggtaagtccttaccttcagtccggatgaagtggttgtgacgagcaaccatgtcgtccatcttttgtgcgaaggcaacggccttttgttcgtaaccaggtacgctcaagatagcgtccttggccaagtggaaccggtcaagtttgttcaggacacgcatgtcgaatggagtggtaatgtcaccattttcttcgtagcagtgtacgtgaaggttgcggttgtgacgtgggaagaagagactttggatcatgtcgcggaagccgtgccatgcaaagatcactggcttgtcagcagtgaagtaacggtcgaattcttcgtcgctaaggccttctgggttcttagcaatcgtcatcaacttcatgatgttgatcacgttgatgtaacggatcttcagttctgggaagttgtcgtgaagcaggtcgatagcggccagagcttcttcagttggttcagtaccagcggaagcaaagacaacatctggttctgcgccttggtcagtggatgcccagtcgatgtagccgaggccgttagcaacgagttcagttgcttcatcgatggagaaccattggagacgtgggtgcttggaagtaaccagcacgttgatgcattcacggtcacggaaagccacgtcagagacagcgagcagggagttcgtgtcggctggcaggtattccttgatcatgtctggacgttccttttcgtaaaggtgcgtcaacagacctggatcttggtgagtgtaaccgttgtggtcttgttggaagaccgtggaagtgtccacgaaagtcaatgctgggtagtcgtgacgccagtattgttccttggccttacgtaaccacttcatgtgttgagtcagcatggagtcaacaacacgaccaaatgattcgtaagttgcgaagaacccgtgacgaccagtcagggtgtaaccttcgagccaaccttcagcttggtgttcggaaagttgggagtcgatgatccgaccagtgtggctcagatcttcgtcgtttggttcgtggatgtcttccatccaagtccgcttcccgctgtcaagggcagcgtaaagacggttagacttagattcgtccggcccgaagccacggaaagtagttgggttaagttcgatcatcttagcgatgtacttaccccattcgagcatgtcttggtgcatttcagtaccgtggttcttcacgtcaacggcgaagtcacggtagttaggcatcacgagttccttcgggttaaccccaccgttagtgatcgggttaacagccatccggcggtcgccttctggagtgttagcaacaaccttttcaaccggagcaccgttttcgtcgaacagttcttctggcttgtaagacttcatccagtcaacgagcatgtccttgtgttccatgtcgtcttgggtcaccggaatcggaatttggtgtgcacggaaggagttttcgatcgggtcgccgttcaagtccttaaccggaccagtccaacccttcggtacacggaagacgatcattggccattgtggcatggagtcgtcattgttttcacgagcgtgcttttggatagccaggatgtcttcaacagcggcatccataaccttagccatttcttcgtgaacttccatgtgttccttgaggccatcaaattcaccacctgcgtatgcagatacgaagtaaggcttccagcccatcccttcgaagtatttagtcagttcttcgtcggacatccgggaaaggatggttgggttagagatcttgaacccgttgatttgaaggattggcagaaccgcaccgtcagtgattgggttgatgaacttgtcagagaaccatgaagcagccaatgggccagtttcggcttccccgtcaccaatttcaaccgcagcaatttggtctgggttgtcaaggattgccccaacaccgtgggaaagggagtaacctaattccccaccttcgtgaagggaacctggcgtttccggtgcggcgtgagaagcagttccacctgggaaggagaagtgcttgaacaacttagccatcccggcttcgtcttgggtgatttccgggtaaatttcggtgtaagaaccgtccaagtaagagttgttaaccatcacttggccaccgtgaccagaaccttcaatgtagaacatcttcaggtcgtacttcttgataacccggtttaagtgggcgtaaatgaagttttgcggaacaatcgtcccccagtgaccaattggcttcggcttaacgtcagaagccttgagttcttggcgtaacagtgggttgtgcatcaagaacagcgtaccaacactaaggtagttggcggcgcgccagtaagcatcaacagtttccaagtattccttggaattgtaatctactgccatcaatatacactccttcaattcaataaaagataactacgtttgacttgtataacgcattgtaaatcgcagatcaatttacgctttctatgataaccgatttggcgtcaaagtcaacctttttaaaaattggaccgtatcaatttcacccaattttaacttttcccgggcactttaaaccaatcttgtcaattgagacccggaactcctagtcagttaagagcttttcgatcgttttaaaaaccccattttcatcattagtcggggcggtaaatttggttaccgctagtacccgcgggtccccgttggccatcccgtaactttgaccgacgtaattgagcatcgacaggtcgttttgaccgtcaccaaaggcgaccaggtcggccgggtccaacccgtggcgcttgactaattcctttaaaccggttgctttatccatcccagccacgatgatatcgaggttgccgtagccagacgaaacggcctcgagcaccccggcaaagtccgcgttgattttagcctgcagttcgtgggtccgctccttaggcacatccatcatcatcttggtgaccttgtcgtctacctcactcaggctgtcgatccgcttcatgtgggggtagtgcttaatggcgtgctccacgaaggccgggtcctcatccttgaaggtgtaggccgtatcgtaagccgaaatgatgaagtggctcccgacgattgcttggtgtaaggcgttcaccctttccaccgtctccatggccacttcaccgcagtacaccaactcgccgtgatcaattaactcaaccccgttttcggccacgaaggctagctggtccttgacagttggaaaccgatcttctagttggtaatgggggttacccgacgccaccacgaactgaacccccttggccaccatcaggtcgtacactttggcgaagtaatcgtgatcgtagtcgctttgggaattcaaaaaggttccgtccatgtcgacggcaattgccttaattgtcatcagttattactccttattaattgaaacaaaggtgttgtagcgcatgtacttatagtggacgcgcatgttggaaacttcaaagggcgtcccatcgtctaaaaagaacaccccttccatgatccccactggttcggtgggggtcaagtttaagagcttttggtcgttttccgtagacggggcgacggtcaaggtcatgtaagaacgggtgacggtcttgttcatcacttcttctaagtagttaaaaatcgatccttcgaccaccgccggcgacagggtcgggttgatcttaatcgggatgtagcccgtttcgatcatgaggggttggtcgtcaatcaaccgcagccgttcaatccggtaaacgaagtcgtcctcactcaagaagaggtcctgttggatttcttcgtcggccggaatcacctggtaattcaagagcttgatcgcctgcttgcggccgtcaaacttgaaactatcggtgatccccaggttgctcccctcgtaagaaaacatcgcctggttctttaagtaaagcgggttgatgaaggtccccgacccccgctttttgaagatgatcccctgttggaccaggacgtctagggcccgcttaatcgtactccggctcacctcgtaatcggcgctcagcgtccgttcatcggggagtttcatcttggggtactggtgggccaggatcttctgttttaagtcgcgcatgacggcgcggtatactaggtctgccatatcaatcttccccgtccttacctgttcgtgtatgctatgcttatcgtatttaggataccatacctttgaaaatttggttacctacatttaaattattggaccgttccaaattcggaagcggccagcgaaaaggagtccaatttatgagcaagaaaaaaagcaagttaaaaaagacccaggtggaacaaatcctcgataaaaacgggatcgcctaccagcaggcccacttcccgactaaacaagatggcgacgtccaaacgatggtggttgaccacggcgacgttgatgagcacctgatctataagaccctggtcttgaccggtaacgtcaccggccccttagtgggggtggtccccgtcgaccgccacttagacgaaaaggcgctcgcccgggtgtcgggcaacaaaaaggtcgacatggtccccctaaaggacctcttgaagacgaccggttacgtccacggcgccaacaccccgattgggatttacgaaaagcaccattacccaattttcattgataacgaagccaaggagacgccaacgatcttcgtttcctccgggcaactgggccgctcggtgcagttaaacgccaaggacctcgccaagttggtgaacgccaccttcgccgacctgcaaaccaagtagccgatgaccaagttcttacagatctttttagacgccagcctctacctgctgttaatcccccttttgtttgggagcgccctgtccctggtttcccaccgtaacaagtcattggtggtcatctactatggcttctttgcccaggtcattgggggcgggatcggcatcatcatccacgagctaagccacttgatcgtcgccctgctcttccgccaccaaattaagggcgttgccttgttacgcatcccccgcccaaacgacggcgacaccagccttggctacgtccagcacgcctggcaaaccacctccttgtaccagcgcagcggcaacttctttatcggcgtcgcccccttgatcggcggtacggtcgccctggtggctttgacccgctggctggttccaccaatctttgcttggtggcagagcctggcaaccggggtctctaccaccgccaccggcgacctggtctggtggaaggttttaatctgggtggtcctcttaatcaacatcagcgtcggcggttttgacctgtcgaccgccgacctggaaaacagtagccacggcctcttcattctggtggccttttacctactagtcttaatcatcgccagcctcttctttaccccgactcaaattaaggtcgccctgctttcatttatgaccccggtctactgggcactaggcctggcccttttgatcaacctgatcaccctaaccgtcttaaagctactcggcagggcccacgtttgaccccaccttaccgcacgcctacaatgtaaccatcaccatataaggaaggattttcaatcatggaaaagaaactctccgcttgcaccaccgttctcgtcggcaaacaggccaccattgatggctcgacgatggcggccagaaacgacgacacttacggtccgctgaccccgcaacgcttcgtggtctacccgacttacaaggaccaccccaaccaagttaagtcctacctcaaccacttcgtcggcgaccggccggccaacggcgcccgctaccaaggggtacccaacgtcaatttgaccaccgagggggtctacgacgaaaacggctttaacgaatataacgtcggcatgtcggcaaccgaaagcgtctacgccaacgaacgggtgctggcctttgacccactcaacctcgaatccggcctcaacgaagacgtgattgtggcaatggtcctgcccttcattaagtcggcccaggaaggggttgcctacctgggggacctcgtcgctaagtacggctccgcggaaggtaacggggtgatcttctccgacaaaaacgacgtctggtacatggaaattgtcaccggccaccactgggttgcccagcgaattcccgatgacgcctacgccgtaaccggtaaccgggtggcaatccaagaggtggactttgacgacccagccaacttcatgtggtcagacgggatccaagaattcgtagctaaccaccatttgaacccggacctgtccggctggaacttccgccgcatcttcgggaccgccaccgtctttgaccaacactacaacaccccgcgccagtggtacggtcacctggtcttatccccggacgttaagctcgacccgctggacttcgacctgcccttcgtattaaaggccgaccacaagatcaccctagaagaggtcgaacaagtcctgtctagccactaccagggcacggtttacgacccactgggccacgagggcaccgaacaagaaaagcgcctcttccggccaatctctttgaaccgaacccaaaactcccacgtcctgcaggtccgcaatgacctccccgaagccgcttctacgatcatgtggatgagctttgggatcccgactttcaccccgtacgtgccgttctttggtaacgccgacgaagttgacgcctcctaccgcaacacgcctaaggaaatgaacgtcgacttcaagtcggcttactggatgtaccgggccctgtcgatgctggtggaagcccaccacgccgagttcttgcaagacgacctcgactatttaaaggacgcccgcgaatacttccaccgcttcgttgacgaagtggcgccgctcgttgacgggatgactaaccaggaagccaccgccattttaagcgctaagaaccaagaactggtagccgaaatggccaagcgcaccaaggacttgatggctaagctgatgatgaaggggctcgagttatccaagctgacctttacgatggataaaaatctgtgagtgcgaccaacctcctcgacgggccgtatagctaaactagggcgagggttggtgcgccagtaccgttcttcgcccgtacttagatactaggcccgtggttgagagcacgttattgtgagtgcggaccaaccattgggcaggccgtgggctaagctagggcgggggttagtgcggcacgcactgttctccgaccgtacttagccactaggcctgcagttggggagcacgttattgtgagtgcggaccaaccattgggcaggccactgactgaaataggcgcccacactaaatatgtaattagataagggattggggaagggcatcttttcccggtcccttttagaaaagaggttttaacaatgtttccccaactagggttaaaggcctccagcgatccggcccaaattgaggatcgcctaaagtaccacccgcaaacctttgagttcttcaccgacgttcacaacttcacccccgccggcctggccgagttaaaggccggcatccggagtgtgcagggcgccggaattgaccaaatcgtcatccaccaaccgatgaagttcggtgacatccacagcgaattggcggcgccacaaaccgccttccccgacctgtacgactttatcgaacgctccaccgctaccctcctggagttggccagcgaatttgaccttcaaatcctaatccacggtggttactcgggcgatttcccgcgggtgatccccttttatcagagcttagaagcggcccaagcagcggtgctaaaccggctggatcggttccaagaactgggtggtacgcacatcatgtttgaaaattcgatttcggaatttttcgcctatggtaacccggtcaccgaacgggccatcttagaccacggctaccgcttggcctttgacacctcacactgctttatctacctgcacggcgataacgacgccttgtgcgcctccctggctaagctcaaggaccaggtcgtccactaccacttggtggactcgatgggccaaagtcacgattccctgccgcttggcactggtaagattgactgggcgcgcgtctggcccctgttaaacccacgggccaccaacatttacgagatcaacttagccgaccaaaccgactgccaagaacagttggctagtcaccgttacctaacgggcttgatcggctaacgcaaactaaaaataggctggaagaaggggcgtttttcttccagcctattactttatcttcgaatgttaaacaaatattgtgcctcaccaccccccaccctagcttagccaaacggtctgtcgagaaggtcatttcccacttccctacttaatcttagtcggcggcagctgttcttgtaaaacggccaacaaggcggtggtcttcaagcgcgcaatcgtcgtgaccaccgctaggttcagcagttcttcaatcgccggatccaaggtggttttgttggcctcctcgttgcgtaaggcggcattgaagaggtcaacgaagcggtcgtaggcggccatcgggtagttattgacggtcacctggtcaatcgccgcccggatcgtcggcagggcaaaggaaccctttaataacgaaattacggtcacggcggccaactggtttttggaatacttctttttgaccggggcgatcacgatcccctttttgacgtagttgttaatcatcgccttggtcaacgggggaacgccaagcgggcgcaggcggtcgttaaccaggccgattacctggtcggcgtacaggcccatctccggaaagtccgcccagtggggaagttgaaccttactagcctgggtggcgaagcgttctaattgtgttgctgtcatctctgcctcctaacccagtcccactgactggttgacgtactgttcggtggtaacggcggtggtgatgagggcgacggtttcttcttggccaaccgttgcttgttgaatcggttcaccctcacccttgacgttgccgccccgcccggtaaccgggggcgttcgcacgattacgtaagggtgctctagttcatcaatcatcttgacggcgtacaagtgctccattactaatgacgtccccgccgtttgaaaccaggcgccgacctgttctgggctcgcgtcatccgcggtgccggggaccccgtgcatcacgatccgcttcggcgccggcgaccgatcgactaaggccaccaggtccgccaccaagtcaccaaccgggtccaaggggttcggcaaccataccaaggtcgtctccggggccagggtaccggaaaagtctgccgtcgtggtgaccgccgccccttgctcggttaaggcttgggccacgggggcaactaacttctccccaccaattatccgtacttgcattttaatcaccatttttccttttattgtaccgcaaactggccggtaacggggacgggaccaactttccgttcggaactggttatcaatgttataataattagtactaactttatcagaccgccgaataagcacaccagtttaaagcgagggattcgttattttggacagccagcaaatcatgactaacatcagcattattttaatcacctttattttcgccgccttcttcgtggccgccgagtttgccctggtgcaaacccggattaccgccctagaagaggcccaagaaaacttcgaggagcgccggggtaaaaagagcctcaagatcgaacgggcgctcacgatggtttctaacttaaccgagtacctatcgaccacccaggttgggacctcggtgtgcgggatcatcctcggttggatcggggagcaaacgatcgaagaactcctgatcaactttttgaacctccccgccctagccctgtcgaccaccggtgcccacgcaattgccgccgtcatcggggtcctcttgttaacctactttgaagttgtcttaaccgagattgtaccgaaaaacatctcgatcgatatcccggttaagatgctactcttcaccgtcacccccttgcactacttccacctgctcttttaccccttcgtgtggttgcttaacacctcggccaacgggcttatccgcctggttgggatgaaaccggccaacgaagccgacgaggtgctgtcgcaaagtgaaatcatctccttgtcacgcaatgccgtccgcggcgggcaattagggcgcaacgacttggtctacatggaacgggcctttgacttcaacgacaaggtcgccaaagacatcatgattgaccggacccaactaaccgtcattgacatcacacaaagcgttggcgacgccctcgacctgtacatcacctccaagtactcacgcctgccggtcgtggccgacggtgataaggataagatcttgggctacgtctttaactacgacttgatccgccaacagcgcgtcgaccccaccgtttccttagccaaaatcttacgccacctgtcaacaacaccggaagccaccccgatcaccgaggtcttgcaaatgatgatccggacccgggtaccgatggtggtggtgatggacgaatacggcggtaccgccgggatcatcaccgacaaggacatttacgaagagctcttcgggaccgtccgcgatgaaattgataacgtcgccgataacctgatccaaaagggtgaacacggtcaatacctagtcgatggcaaaacgaccacctacgattttgaacgctacttccacaccgacatcaaggcctttgaccactccaacgccgttaccttagccgggtttgtaatggacacggttccccacgttcacgagggccagacgattgaactaggcgactttcagttaacggtggccgactaccaaaactcatacattgatcgctttgtagttcaacgcctggaaaaagaaccggactcgccggagtcacccaaccccggttctgccgcttcttagcgcgcttggtcaccaaagtcgcccttttaaatccccccttccccaggtaaaatagaatttatagaataatcaggaggccttgtcgcatgacaaccattaacgtcttatacatttccatcgaggggaacacccgctcctttttaaagcggctgcaaacctacgctaaccaaatgaacagcatcaaccccgctaatccgaccatcaacctcaaggaaatcaccgcccaaacgatcccggcccacgaagaagagcccttcttcgccttcgtgcccacctacctggatgggggcgacggctttacctctggttataccgaaatgatgaccaacccgctgggtgaatacatcgccgagggcaagaacgccgacaacttgatcggcgtggtcggtagcggcaacaaaaacttcaacgagcaatactgcctgaccgcccggatgtacgccaaggcctttgacgccccgttcgtagccgattatgaactgcgcggcaccaacgaagacttggaagtggtctaccggcgcctaaaggatgtggcggagaaacaaggctaagaagtgctcaccaacctgcttggcaggccgtatgactaagctagggcaagggttgccgccctggcggcgttctttgcccgtacttaggcactaggcctgcggttggggagcacgttatctgtataatggttaaaaagaatccccgaatgaaaaatcccgaaccggatcaatcaacactcgattgatccggttcgggattttatttaattgaagtctaaagaggaggttgggaacactcacttctttattcatgctttacaaacccagccgaaatcagccaggtaatgccatagcggtccacaatctgacccgcctggccccccgctggttgggggctaaagggtaacgttacgcgctgatcatcggaagcggccaagtggtcaaaaaagtcggccgccgcaacgttatcatcggcaaaatcgagcatgatcgaaaccaacgaagacgtctggggcattgccatcatggcgtcagcacagatgaaggtctgcccagcgatcgtaaattcaccgtaggcagttgtttcgtctaagtccgttagttccagaccgtagctatctacctgagccttagttaaggggcgccgcgccactatgtcagcatcgaactgctcagcgtagtaggccatggcctccttggcgttttcaaagaccaagtaggggtatatgtctgccattatgttcctccgtttttttacagtatcaaataaaattataggggcgatcgggccattcgtcaaactgccccaccccatgaaaccgaattaacattgattaaccgggacgtaaaacggtttaacattttgtaaaccatgttatactagactagcttaatttttacgaaatcattaaagaaaggaacgcccttcatgaaaactactcgtcagcacagcgcctttttgatcatcgggatcttcttgctcggggctagcatgcgcaccccattcacctcaatcccttcggtgatcaacgaaatcgccgctagcttccacaccccggccacctcgctggggatcttaactaccattcccctaatttgctttggcctttgttccaccctggtgcccgggattgcccgccgtttagggaacgaactggcccttttcatcgccctattgttgttagccgccggttcttacctgcggatctttggcttcagcgcccttttgaccgggaccttaatcattggggtggcgaccaccttcattaacgtcttaattccggccgtcatcaccgagaacctaccaacgaagattggcccggtcaccgggacctataacgtggcgataaccctcttttcagccgtcggggcctacgcgatcgccccgatcagcgccgcctccagttggcaatttgccatcgtcttattgtccgggttagtcctcttcaccgccctggtgtggttacctaacctacgctttaactaccgaacatctgggacggataccaaagaaaccggcgccaacatgtggaagaacccacgggcctggttcttattgttctactttgccggttcctccttcgtcttttacacgatcgttgcctggctaccgtcaattgcgatggctaacgggatgaccaccaacaccgctagcctgattgccgggatcttccagctcttctcgatccccactgcctttgccaccccggtgttagccactcggatgagcaaccggattcccctagtcctggcggccgggatctcaacggcactgggctttttggcgatgttacttcccatccaccagttctggtactacgtcctaatcgccctcttacttgggttagggacggcagccaccttctccttaatcatgaccctgttgggcttaaagacccgcacggctggtgacacccggaacctgtccggaatggttcaatcgctgggttatctactggccgcctttggtccgaccgtgaccgggaacctcaaggccgcttccggttcttggcacggcccgatcatcgtcaccctgattgtgatctgcttgttcaccctctttggaaccctgagtgaacgcaatcagtacgtgaattaggaagtgcgacctaaccattggcaagccgtggactaaggatcggacgagggttgatgcgacacgcatcgttctccggccgtacttagacactaggtccgtggttaggagcacgttatgggaagtgcgactaaccttctcgacgggccgtatggctaagctaggctgaaggttgatgcggcacgcatcgttcttcagccgaacttagacactaggtccgtggttaggagcacgttatgggaaatgaccacgggttagcgcgccagcggtgttctgtggccggacggttactaagagtttgaaaaatttatttcaatctagaccaattgacacgaaaaccggttagcaggctgttcaccgctaacacggttggtgatccatttcacgaaagcggcaccactactaccgggcgcccgtgcaatcaatttccagaaagtatataattagttcgttaaggttgtattctttgatcattcttagaggagtgaacattttggctaaggaaaataaagctgttatcacattattcggggccaccggtgacttggcccaacgcaagctctacccatctttgtttaacctgtatcaaaagggttaccttgcggaacactttgccctgctcgggacgtcccgtcggccggtttccgacgaagaattccaagcaatggtggaaaagtcgatctctggcattgacgaagtgcaagctggtaacgcccaagcgtttgctaagcacttcttctaccaatcccacgacgtcactaagccggaacattacgaagtgttaaaggaacggcttgaaaagttggacgaacaattcgaaacggaaggcaaccgcctcttctacatgtcgatggccccacaattcttcgggacgatcgctttgaacttaaagaaacaagccctgctgactgacgatgggttcaaccgtctggtcatcgaaaagccatttggtcgcgactttgcgtctgccaaggccttaaacgatgaactttcccaaacgtttaaggaagaccaaatcttccggattgaccactacctgggtaaggaaatgatccaaaacatcgaagccctgcgctttgggaacacgatcattgaatccctttggaacaaccgttacatcgacaacatccaggtaaccctgtccgaaaagctcggggttgaagaacgggccggttactacgaccactccggtgctttgcgtgacatggtgcaaaaccacatcatgcaagtcgttgcccaattagcgatggaacaacccgttgccttcaccgactccgacgtccgggttgaaaagatcaaggccctgcgttccctgcgcttgtacacaccgtcagaagctgcttctaacttcgtacgtggccaatacgacgccggcgctgacaacccagactaccgtcatgaagacggggttgacccacaatccaacaccgaaaccttcgtggctgccaagctgatgtttgacaactaccgctggtccggggtgccgttctacgtgcggaccgggaagaagctggctgacaagttcacccgcatcgacgtggtcttccgtaagccgttaatcgacatcttcgctaacccacggatggcttctgaacaatccctgaagagcaacgtcttgaccatctacgttgaaccgcaatctggttttgccttgcgggttaacgccaagacggccggccaaggtttccaaactgaaccggttgacctggagtacatgcaaaacgactccagcaagaaggaagctccagaaccgtacgaacgtctcttccacgacgccttagaaggtaaccacaccaacttcgcgtcctggtctgaaattgcctacgcatggaagttcgttgacgtcgttcgtaagctctgggacattgaagaacctcaattcccgaactacacgccaggtacgatgggcccagccgcttctgatgaactactggctcgcgatggccgggcatgggtctacaacttaaaccactagacctcacggtgatggtagcgcttttggtaaaaattggtagctgactaatcacctaaaaaggaccggcatgggcgccatcacggccttgttcaaagttacgcaaaggtatttccccacccggttcaatctgttataatgtcacttgtatgtaagtaattgtttatttaaggagtgtgacaacacaatggctgatcaaacggcacaaattggtgtaatcggtcttgccgtcatgggtaagaacctggcgctgaacattgaaagtcgcggcttcacggttggggtatacaaccgtcaccgtgaacggactgacgaaatgatgcgcgaccacagcgaaaagaagctcgtgccttcatacacgattgaagacttcgttaactccctggaaaagcctcgtcgaatcctgatgatggttcaagccggtaagggtactgacgctgttatcaacgaactgcttccgctgctggacaagggtgatgtcttaatcgacggtgggaacactaacttccacgacacaatggcccgcaacgctaagctggacgaatctggaatcaacttcatcggaatgggtgtttccggtggtgaactgggtgccctccaaggtccttccctgatgccaggtggtcaaaaggaagcttacgacctggttgccccaatcctgacccaaatcgccgctaaggctgaagacggcaagccatgtgtttcctacattggcccgaacggtgcaggtcactacgtaaagatggtccacaacgggatcgaatacggggacgaagaattaatcgacgaaagctacaacgttatgcgtaacgttcttggcctttccgttgatgaaatggctgacatcttcgccgaatggaacaagggtgaacttgattcctacctcgttgaaatcactgctgatattctgacccgtaaggacgacttaggtgacgacaagaacttaccaattgttgacgctatcttggaccgtggtgctaacaagggtactggtaagtggtcttctgaaaccgccctcgatggtggtgcaccacaatccgtgatcacggaagccgtttacgctcgttacatctccatgctgaaggacgaacgggttgccgcaagcaaggaacttcctgaagacgttgaaaaggttaccctttccgacgacgaaaagaaggaatacatcgaaaaggttcgccaagccctttacttcggtaaggtgatgtcttacgcccaaggattcgaacaaatgcggatcgactccgaacgctacgactggaacctgcaatacggtgaattagctcaaatctggcgtgaaggttgcatcatccgtgcccaattccttcaaaagattactgatgcctttgaaaagaacccggccctcaagaacttgcttcttgacgactacttcaaggacattgctaagaagtaccaaaaggccattcgtgaagtggttgccctctccgttaaggctgggattccggttccttccctcgccgcagccatcaactactacgactcctaccgtgcagaagttctgcctgctaacctcttgcaagcacaacgcgactacttcggtgcccacacttacgaacgtaccgaccgtccggggaacttccactactcctggtactaagaacaataaaaactgtttactcagttcaagagcctcctgcgggaggttctttttttactttgtgttgcatttcaattgtaaattcgccgcgaaaaaaagggctctttgtcaaatcctgttgatgggtcattttaggcggcggccggtgcttgcacctggcgccgccttttttcagcttccgttcccatttgatgcaatcggatccgggcgatgaaatgaccaaagttagtaaagccatatgccgtccgttgaattaacttgatcatgcggttgatcccctcaacccgaccgtttgagtacggtaatacggttgcgttgtacactccttcgctgttcttacggagggtcttaagaaccgtttggaacggcgctggcacgtcccatttggtgaacaagaggtccattaattggtcaacatcgtgctcttcaagagcggtcatggcgccctgtaagagttcataaccggccgctaactgaggatcaaggtccaggccaattcccacccgttcggccatcgttaccttttgtcgtaagtggcgatcatagtactccttagtgtagttaagcgatgtgcttttaagtaagtacagtcgccacgaattcttcaatgcccgatactcacgcgtattagggtcgaattgcttcattactgcgacccggacttggttaaacgcccgcgtaagcattgaaacgatgtggaatcgatccacaaccagctttgcgtttgggaagtagcggcgtacaaggccttgatagtaactgtttaagtctgtcgagactgatttgactcgtttgcgctcttttagcgagaatcgatcaaagtaatgcgtaatactactcttaagccgatcagggagaatttggtagatttgtgaggtatcattatcaacgataatgaagcaatacttcccctgcggaccacggaactcatcaatggcaatattagtgggtaaagtgcgactattaaagcgaaggagcgcttgatcactgtctaggagtcggccaatggtactaggtgacacaccggtaaacttagacacgtccttttgagagacattactttcaagcatcgtaagtgccttgtgtttaactgctttggcaatggaacagtatttatcaacgacgttggtcttcgccatgaacgaatcttggcaattcttacatctcaggcgttgcttaccgatccgcaacatagtgggacaactttcgttaattgagaggtacttaatggtttggtaagaatggccattcttaatgaaggtatccgcaaagccgcaatgtgggcaccgatccaatttaagcgagaccgtcccaatgaagacctgcgtctcccatccgtcattattttcaaagacaacgtctgtgaaatgaagattggggtctttaatttgaaggatatttttaatataatcagtcataaggtcacacctcttactttctggaatttgcgtggtagttaataatcagaattttaaggctggtggggcctttttttgtgcgacgaattgtcaaatcaagcgcaactttgtcccgaagaaaacttcaaatggactcttccagcctaagaccttacgtggtcggtgatttaaatccctgacaaacttgtcgatatcttgatcagttagttggtctaggtcggttcctttggggaaatactcacggataagcccgttggtattctcattggttccccgttgttggggcgcatggggatcgggaaaatagactggaatgcttagttcttggctaacttcacggtatcctgcgaattcagttccacggtccggcgtaagcgtccgaacgcgtttaggcgttacggtatgcaggaggtcaatcatcgcttgtgtgacgttcttggcgtttactttgagaacgcgctgagataataaataccgagatttacggtccactaaggttaccagggctgaacgcccggttttaccgcgaattgtatcaccttcccaatgaccaaaccggcttcgattctcacatgaaaccgggcgttcatgaacggaagggacgtcgttaaatcgtcctcgacgttccttaatggttcccttggcctttcgggttttaccacggtgacggagcttacgggcaaagccacgagccccgtgactcttacgtttgatgcctaaattatcgcgttcaatcccacgataaatggtgttataactgatacgccattcgctgttttcgtgggctaaacgacctgaaatctgttccggggaccactgacgttgaacaatacagtgaaggataaaatcccgtaacttcaagttagttagaagcctaggacgtcggctttttagtcgacgtccctgatagttctcttgggccttgacggctgagtaagccttacgaccgccattgcgtttgatctcgcgcgatacggtggctttagaacacccaatcctctgcgcaataacttgataggtgtccttcaaagtgacgcctaatagtatgcattctcggtcttttaaggtaagatggttgtacgaactcatagcctaagatctcctttagatgtttgttgtggtaacttcattttacaggactcaggctatgagttcttttttattttcttcttacttgttgcacttcaattgtaaattcgtcgccctcaaaaccaaaaaatcctgtcaacgaatcaccactatggtaatccatcaacaagatttagtgtagagccaaaaaaagaggctggacttattttccaacctctttttgctgttacacagataacgtgctcaccaaccccaggcctagtgcctaagcaggccgaagaacgatgcgtaccgcatcaaccgttcgtcctagcttagtcatacggcctgccgacgggttggttcgcacttctttttttacttttccggcaacttattgttaacgtcggtccgcaccaccagcacgtccacttgggcgttccgctttacaaaggaggtcactgagccaaccatcgcccgttgaacccgggaaaggccactcgcccccatcatgatcaagtcattgtggtggtcgcgtgggaaatcaaaggaaaccaccgtcttagggttccccaaccggatgtgaatgtcgatgttgtcaaagccttcttccttcttggcccgttccagcagttcatctaagtactccttggacttgtcaactaattggtaggcaatgcttccgtcagacatgccggcgaagttgtaagacatcgcccgggtgtcgaccacgtttagtaaatcaaggtgggcgccgttacgtttggccgttgccaccgccttgttgaaggccagttctgcttgcttggatccgtcaaccggaaccaggatgttttcgtattcttggctcataaaagtaacctccattcactcaactctttcactcattataccattgataaaaggctttcaaaaggcgggatcactcggaactgcaacaaaattgacttttgaatccaaaacgcctaaaattctcacaaacgttattggttcatatgaagggacgctcacttatggataccatcgatcaaaaaatcatcaacatgctgcaaaaaaacgctcgggtctccttaaaggaactttcggcggcctgctttatttcttcccccgccatcgccgcccggattaacaagctggaaaaggccggtatcatcaccggctaccacaccacggtgaacctggaaaagctcaattaccacgccaaagccttcattcaggttcaactcgaacccagccaaaaaaaggaattctacccgtatgtggactcgattcccaacgtgattgaatgcaactgcgtcaccggtgactactccgaagtgatggaagtggtctttgaaaccaccgccgctttagatgaattcatcaacgacatccaaagccgctttggcaagaccagtacccaaatcgttttctccaccagtgttgagcaccgtggattacacctcgccactgaagacaaggaagactaagcacatcccccacccttacccaggtgggggatttttttagctgtttaggttaccggtaacccaaaattaaataatagttgacttctttacaccgattggatcaaactttaagcgttaatttttcaggaaaccggtaaactaaaagggagtgtcgtttcatgttcaacatcaacagcttcaagttaactgacaaggtcgccatcatcaccggcggggtctcggggctaggtgaatactacacccgggccatgctgacggtcggcgctaaggtgatggtggttagccactccgagcgggactgggacaagattaaggccgtcgccgcagagcttggtggccaggtcgccttcttcgcccaaaacgtcaccgcagaagacgccccgcaaaagattgttaacgccaccttggaccaatacggccgcatcgacatcttagtcaacaacgccggccgccaaattcgccacccctgggatgaattccccaaggaagactggcaaaaggtgctcgatttaaacctcaattcggtttactacctttcccaagaagtggccaaggtaatgaaacgacagggcggcggtaagatcatcaacattggttcgatgcaatcctaccgggccggcaagttcatcttcccttacaccgctagcaagcacggcgttgtcggtttaaccaaggcttacgccgacgcattggccgctgacaacatccaggtcaacgccctggcgccgggttacatcaacaccccgatgaccaaagcgctacaagaagacccggttagaagcaaggaaatcttggaacacatcccggccggacactgggccgaaccggctgaactaatgggcaccgttgtcttcttggccagcacagcttctaactacttcaccggggtgacgatcccggttgacggtggctacctactgcgttagtaagcaggtgaccagattggccagacaatacacaaccattaatgacattgcccacgccgccggggtttccaagaccaccgtttcgcgctacttaaacgggcactttgagcgcatgtctgagcaaacccggcaaaaaattgcacagatcatcgaagagacgggctaccaagccaattcgcaggcccaggccctctcccaccggcaaagccacctgatcgggatggtggtagccgacatcgaaaacatcttttcctccctgctctttaagggggccgaccaggtgctagcggccgccgattactcaatcatgctgatgaacgccaacaactccgccacgctcgagcgccggcaattagaacgcttgattaaactccgggtcgacggggtgatcctccagcccagcctgatgaatgccgacacctaccagctcttagcagacgcccaggtaccaacgatcatcgtcgaccgtaaagtcacccccgctaagtggccccaagtcgtcaccgacaaccaggggtactctaagctcctggttgactacgccgcgcgccaagggtttcagcaggtagtcgttttaagcgaggcgatcaacgccaattcggcccggctggaacggttggccggggtgcaagcggccgccaaagagcacgatttaacggtccaccaagtcgaaatcacccacgatgagccgaccggcagcatttacgctaagctagctcaggtaccggactggttgaacgggcgcaccgttatttacgcctttaagggcaccttgttaacccgcttaatggagaccctggccgagtttaacgtccagatccccaaggaggtcggcgtgatggcctttgacgactgggactgggccaaactgatgtcgccacagatcaccaccatccaacaggacccgcaacaactaggtcaagtcgccgcaaaaaacctcctcgccctgctcgaccaccaggaggtcccggctacgaccctggtcgattcccagattatggttcgaaagtcgctatagctaaaagtgagtgcggaccaaccactaggcttgcggttggggagcacgttatcttggaagtgggaaatgaccttctcaacagaccgtatggctaagctagggcgaacggttggtgtggcacgcaccgttctttacccgtaattaggcactaggcccgtggttgggagcacgttatctttggaagtacgacccaacctccttggcaagccggattgttaaaggcactataaaagcccagtcacgcgggattccgcacggctgggcttactgtttagttcttaagtagcacttcaattctgtctaggtaccgttcaaagaccgccaaggcttcctctaggtattggctggtggtggcgtccacaccggctcgcttgaggatttcgagcggcgccgccgagcccccagcagaaaggaagttcaggtaggcttccttggcccccggcttgtgttgccaaacggcgctagctaagctggtcgaggccgcccaggaggtggcgtactggtagacgtagtaattcatgtaaaagtgcgggacgtaggcccaagactgggtcgccgtgccgtctaacagggccacgtccggcccgtaatacttcttcagcagggcgctgctggtttggtccaaaaagtcggccgttaacgcctgccccgcctgttcggtttggtaggcggtgtgctcaaactcggcaaactgggtctgccgatagatcgtgccaataaagccatcgatcgcttgttctaagacgtaaagttgcacctttttatcagcttggtacttttccagcaggtagctggtcaggatctgctcgttaaaggtcgaagccacctcggctaagaagatcggggcgtcggcgtactgggccggctggtggtgctggctaaaccaggagtgcatggcgtggccggactcgtgagccaagacgtaggtcgaatacagcttatcggtccagtttagcaagatgaaagggttggccttgtaaacgctgatttggtaaccccctgagcgcttaccggcgttttcggcggcgtcaatccagcggtggtcaaactcctctttcagcccggccgtgtactcatcacccagcacgctcagggcctctaaggtcagctgcttgccctccgcaaaggtcgtcttcaacaagtcatcgccggccagcggggtgttgatatcggcctggttaaagtcggtcaaccccaggtaatcctttttaatccggtaccagcggtgggccaaatccaggtggtcattgaccgttttcaccagggtgtcgtacacttgctcgtcaatctggtgcggggccaaggcggcctggcgccccgattggtagtggcgcagttcggcgaccgcattttgggccccgacaaaggagttgagggtctgggcaaaggtgttgcgtaggtcgtggtaaggcttggcgtaggccaaggtggcctcttttctgaccggccgtttcaaggactcggtgaactggctacggttaccgtgggtcagttggaccaggttaccctcatcgtcgtgaacctggccaaagttgaggtcggcgtcgtttaaggtgttgtagatttcatcggcactatccaacgaccggttgagccgcgacaaaagcttctcttcgctcgtcgtcagtacgtggcccctttgcaggcggatctgttctaactcgtagcggaattcttcgagtcctggttcctgcttgaaataaccgtccagcgccccttcgtcaatcgctaaaatttccggttccaaaaaggcttccttggtggcgatcgtcgtggccgccttggctaccgtcccaaacagggcgttggcggttgcatcggtggtgtcactgtcccggcgtaagaaggcgtagacgtattctttttccaggtcggtttcgatttgcttgtgagtgtttaatgcagcgagcagctccttggccccattaagatggccggcaaacccggagagcttgtcggccagcagtaaggtgtcatcaaggtccgcccgcatggcgtcatcggatgggtacaaaagcgtcaagtcccaggttaattcggtgggaacctcatcgcgcgccagtaaacgggtgttggtcatgattatgcttcctttaaatcttcttttttgtagttatctaagtagtggtggtacttgtcttggtctagcgacttttcagattcaccaattaccaacgtggcaacggtgttcccgaccacgttgacggcggtccggcccatgtcaacaaaccggtcaatcccggcgataaaggttaagccggctaccggcaccccgatcgtagaaaccgaggctaagaggaccacgaaggaggcccccggtaccccggccatccccttggaggtgatcatcaagaccaccagcagggtaaactggtgctcccaggtcaggtgtaagccgtacgcctgggccaagaagagggcggctaaggattggtaaatcgccgacccgtcgaggttaaaggtgtaaccagtcgggatgacaaaggaggcaatccccttgtcgacccccatcttttgggtcttttccatcagccgcggcagggtcgcctcggagctggcggtcgaaaaggccagcatgatttcttcaaagaccgcccgcatcgtcttccaatagtgcaggtggaatatcttagccacgatcccgaggaccacgacacaaaagatagccattgttacgtaggcaatcaggatgaagtagcccagtggcaggagggcggacaaccccatttgggcaaccgtcattccgatcaggccaaaaaccccaattggggcgaacttcatcacccagttggtgaccttgaacataacttcggaaacgccgtttaagacgtccactaagaccttaccccgttccccaatcgcggcgatccccagaccgaagaagacggagaaaaagatcacgggcatcatttcccccatcggctagggacttaaagatgttcgttggaataatggctaaaattgtatcccaaatcccggtatgggaggccgacttagcggtcgtcatgtacttggaaatatcacttccttgtaggtcatggatgttaataaaggtcccagggtgggcaaggttaccaactaccaaccctaagacaatggcgatcgtggttaagacctcaaagtaaatgatggtcttaccaccaatccgaccaagcttgtgtaggtccccgatgttggcaatcccaaccgtcaggcaggagaccacgattggtaaaacaatcatttgaattaaccgtaggaaaatcgtccctaggttactcatgatcgtaatggcgccctggttatggtaggtaaaggccccacacacaatccccaggacgagtccgatcacgatttgccacccgagactcaggcggaaaaagcggtacttcttcataaagaatcctccatctcatatcttttaaaagtcactctcattattttatcacaattccaggatttctttcggtttttccgcaaattaggtgataaaccaatttcgtgatttactaacttgacgggctttgccggttaaaacagcggcgccccgattttaaaagccgaactttcccaatcaatctttaaaatttccctagaagttgtatcataaaacatgatcgatttgccatgaaaggaattacaccatgataaccactacccgcgccgataccctgtccgggcgctttttcttcttattcgtttccatcttcttaaacgccttttctaacgccctgaccgtttccaccaatatggggtcggcgatctggaccgcctcggccgttaacttgagccactgggtccacctctccttagggaacgccctttttttggaggggatcgtggtcgccgtggccaacctctttttactggggcgttttgactacttccgtttgattcgcaacctcctttacatcacccccttttcctatttactagccggctttgaacacttcttcatttccctgggggttggcaccctccccctgtggtggcggctaatcttagacgtcgttggcctctttggggtcgccgtggccgtttcaatctaccagcgggccaacttgatcatgcaccccaacgacgaccttccctacatcctgcgcttccgctttatgcacgggtcaccagtttggtcccagtgggcctccaacgttccgccgctgttgatcgtcttgttctcctggctctttaccggccaattattcgcctttaactttgggaccttttacaacatcgccacccagggttacctgattggctgggctgatcgccacgtcttcaagaacttacaccaccatttggaatttaagaattaggaagtgctccccaacctcagggactggcaattgccagcctctttttttacttttggcagattgcaagaaataacttgaacaaatttagtaacgcagattacgtaaaaagatctcaatcggtgttcgccaatttaaacatttgagtggtcgggaattctaataccagttaatttgaatcaattcatcatcggtaatctcatcaattggttgacctttgggaatgaagcggcgtagtactcggttgcgattttcattactgcctcgttcatgtggcgaataagcgtgcgcaaagtacagcggaacaccggcctgttcttcaatcaaattgctcctatcctagtatttggtacataaatttctgaacagttgtgccataattaataaaacaagataggagcattccaatgaaacgatatcaagatgattttaaagccagcattgtgaagatgcatcgtgaagagaaaagatctattcgctcgctttccgaggaatacggtttttctccagccgcaattcataactgggttaaaggcgctaaatcagttgagctagaagacggtactgaagtaacgtccaaagaattcaaacaacttcaaaaggaaaatcagcgattaaaagaggaacttgaaattttaaaagctgcggcggtgttactgggaaagcattaggacgaattaattgccttgtcttcatagaagatcagttattgcgacaccgcttatcaattattctttcggcactgaaattactgtgcagcacctattaccattggaaaagatatcaacctagtcaacacgaacgtgttgataatcagctcaaagaaaaaattaaattgatttgggaaaataattatcgtgcctatggttatccacgaataacgatggtgcttcgcaagtcaggcatctgtgttgggtcaaaacgaattttacgattaatgagggaaatggagattcactctttaatgaatcggcgatttaaaaaacctggcactcatgtggatcattcacaacgccccaatttaatcaagcaccagcccaatgcaagggtatggcgtgctgacattacttatttggaattacgtccaggaacctgggtttatctcagttctatttacgaaccaaaggttcatcaagttcttgctttcaagattggtcgtcagatggaggcgacgttagttgtagaaacgattaatcaggcgcttgaatgtcatcaaaagccacaatattttcactctgacatgggttcacagtacaccagcaacgaagttgaaactttacttgaacggcatcagattagccactcatactcaaaacaaggttatccttatgataatgggccaattgaagcttttcactcattgttgaagagagagtttgcctttcaaacaactttttccgattttgaggacttggtaatccgaacctcaaattacatcagttggtttaattccgacagaattagaacgagtgtttagaaaaagatgtgccatttattgacataggagcaatatttgagacagatacgcatcaaaaaaaaaggcaattcatcacgtccttaaaagaacgtgtttccttgcccgctttcaaaaaaagcgtatcattgaaagcgtaatgattaaaacgttttttacaaacgttatagaggggagaagttaatatggacttagtcgaagaactagtcaatgttgttggtaaaaaaaatgttattactaacaaagcaaaatctttacgttttaggaaagggtaccgctcaggtaagggcgatgcagttgcagtcgtatttccaaccactttaatggaaatgtggcgtgtgcttaatgttttgcatgataacaatattatcattattatgcaagcagccaacactagtttgactgagggatccgtaccagccccaggttatgaccgttctgcagttgttgtgaacggcatgaaaattaaagatttacagttaatcaataatggggaacaagtactagcattccccggtacgacactgtttcacttagaaaatgaattgcgaccacttaaacgtgaaccacattcagtcattggctcatctaatttgggtgcatcggtcattggtggtattatcaacaattctggtggtgctttgatcagaagaggtccagcttatacagagctatcattgtatgtttggattgatgaacatgacgaaatgcacttagttaaccatttaggcattgatttgggcaaaacgcccgaagagattattactaatttgcagaaccgcaattttgatttgaatcaagtaccacctactgaacatcatgcttcaatgttccatcatgaacaggttttgcgtgacgttgaatctgataagcctattcgatacaatgcaaatcctaaagaattgtatgaagtatctggatcgtccggtcacgttgcggcattggctgtccgcttagatacattcccaatggataaaaaaacacaaatgttttacattggaacgaataatcccgatgagttggaagatattcgtcgccatattatgacgacattcaaagaattgcctgtttctggtgaatatatgcataaaaatgcttataaattggccaagaaatatggtaaagactcactaattgtgattgaaaaaattggtacgggtcatttgccccaaatgtttgcgctaaaagcatggggcgaacgctttttgaagcacattccgtttttcaaaccttatttcccagatcgtttgcttcaaacattaagtaatttatttcctaatcaaatgccaaagcggttagatgattattacgaaaagtacgaccattacctacaattgaaaatggctggtaatggtattgaagaagcgcgagagtatctcaaatcttattttgacaaagccagtggcgactactttgaagccgatgccaatgagaccagtaaagcggcaactcaccgctatgtaacagctggggttgcgattcgatatcaagaattaaaacaggatagtattgacattttgccactagatatcgcgttggcaagtaatgattataagtggttcgagcatctgcctaaagagattgaagacaaaatagaacacaaaatttattatggtcacttacttgatcacgttatgcaccaggattatattctaaaacctggcgtcgatgcgcatgaacttaaaaaagaaatgcttaaaattttggatgagcgtcacgctgtttatccagccgaacacaatgttgggcatctatatttggcagcaccggccttaatcaagcactataagaaaaatgatccaactaatagtttcaaccctggcattggtaaacaaacaatgtctaaatattggggcgaatactaaagatagattgtaaaatttaaggtactgtaccctgtcaagttgacacattaaataataaaaactagttggccttgccgaagcggtattctgctgcggtaaggtcatttcttttgcctgaaataaaggaatgcgtaaagtaatcgataccttctgtcaccagctgttctaagtcttcaaacgtttgtggttgtggtgagtgtgctaaccagatagatttaaaatcagaccatcagtgctccatcaccgcattatcagctggtgttcctggggctgagtaactatgttggctgttattactagccaagtggtggttgaatgctttggaagtatatgctgctccgcgatcagtgtggattagcggtgccagacctccggctttctgcttggccatactagataaggccggtgtacagctaaagctccccgttgccatcagttgctcgtaaaccgaatatggttggttcgtccacacaatcatccgtaactcctccctcttaccaccattgtaccccttttgattaacagagcggcgccccgcctttaatcaaaaaaggcgtgggaaactttcccacaccctgataattaggcttgtaccggctccgttaggtcgcgcgcttccttaatcccgtgttgatccatgtagtttaaaatttcttggatcgtgatgtagggaacgtttaagcggtcggcgaactggaagaggtcgtcgcgccgggccatgtgaccatcgctctttagcacttcaatgatcaccgctaccggcttggccccggccaagaaggcgaggtcaacggaggcttcggtgtggccgatccgcttacgtaggccgccgtcttgggagtacagcggttggatgtgacccgggtggttaaagtcggttggcttggcagcatcgttagcgatgtggttaatggtggccgcccggtcaaaggcggacaccccggtcgtgacgccggttgcttcgaaggccccatccacggtcgtcatgaagggcgtttcgttcgggtcggtgctgtgagccaccatcttggtgaagcccagttggtccgcccgttccttggtcaggggtacacacatcaagcccttggcctcttccagcatctcgtaaaccgtcgccggggtgatccggtcagctagggccaccaggtccccttcgttttcgcggtcttcgttatcggaaacaatgatgtagccgccattcttcaagtgggtcaacgcagtttcaacgctatcaaacttcatcgttctctttctcctctttttgccattgtgcaactctcttatctcgttcgaacgtgattgtataataacgtacgattaaatcattttcaacccctcaatgccttgatttattaactatattttaataaacgactttaatgttcgcgtattttcgttaacgacggaagcgaacattcgccccttcctaaccactcaattacgttggtcaattcggaaacgatttcactgtgtcgccctccgcttcgttgccgaacgtccggtttgatggttcgggcagaaaaaaaggcccaatttttaaagttcggcatctaaaaagggcgcccctactcggttgagtaggaacacccctcttaattgttattgcggttaacctagtttatcctcgccctttaacagacgggccttttgagcggcacccgcttttgcaaagacagtggtgcaaacataagcagtgctcaccatccccgaaggcggcaactaagccaaaaatcttggcggttgctctaactggggaattaagagtttaagctgcgtctttaggtccttaaattcactgagcgggcaaaaaagtgaattttcgatccgtgtacaccaccaaaaatttgagttctggggcatctaaagcgttcggtactacctgtttgtttaccaagtcgaccacaaccgccgctaagttttcaaaggcgttaacaagtgctgggccgtccgtccaatagcgccaacggtgggcaacgttttccgcggttgccttaataggaaggcccagaatattcaggtattgggtaatcattccccttagttgattagttctgttttttatattccagtaaggaagtactcaggtgtttcatgtgtagtatagcaagggcgcaatcctttaaaggcattgcgcacctcacttaagtatattagagaaaatcgttgcctgtatcccttgtgggagtaggactcaaaaaatcactagcacagggataggatacatttagcgcagtccgccctcctctaaaaagggcatcaattgagtgttattgacactggtttgttaaagtaaattatcgctatatccgttggcgctgtaagtgttacatattatttgatagataatatatgatatatagccccctggggtaaaaaattaaaaattaccgcttgcatgcaagacgattgaaatgtgtgcgctcttttttgtagcggtcagggggcggggggtgtttcatgctaaaatgtttgtgtatggtaatttgtgagaggcggtctcaggaccgtgtctttaaccaagccgctaaggctagtggaaccactccagaaatgatccatacggatcgtggagcggcatatacgtccaccaattacaacgaagctctccgtcaggagaaggtaaggcatagcctatcggcgcctgggacaccagcggataacgccgtaatggaacactggtgggcagattttaaaagcatctggctcgagcatcgtccaaaggcgcaaactctagcagagttacaggaacaggttcgtgctggaataatgtacttcacgaatcagttcatttccgctaaaagaaatgaccaaaccgtggcggaatattaccacgatttggttggataagaaaaattgtgttttcgtttttataagtgtcaacttgacaggggatagtaccccgctggggcgacaaccttttgccctagcttagtcatacggcctgtcgagaaggttgaatcgcactcctcttaacattgtgtcccctttcactagtaaactctggtaaattttttagtaaaagtgttgaaagtttagatgaaagcggttaccattatatccgtaagcaattatatttttatctgctgaggaggaaatgttagccatggatgctcaaaatactaaggcgaaaacatttagttcccggatcgcatattcgtttggggcctttggtcacgatatgttctacgggatgctttcgacttacttcatgatgttcgttaccggccacttgtttaacagcaacgccggtggggaagccgcccggatggtttcctttatcactttaaccatcatggtgttacggattgccgaattggtaatcgatccgttcatcgggaacatcattgataagaccgacaccaagtggggtcacttcaagccgtgggttgtcggtgggggtgtgatttccgccatcgccattgcgctcttgttcaccgacctgggtggtttaacttacaagaacccaatgctgtacctattcttattcgccgttctttacatcgtgatggatatcttctattccttcaacgacgtggccttttggtccatgattcctgccatctcctttgatagtgcagaacgtgaaaagacggctaccttcgcccgggttggttccaccttagggggccaattggttggggtcgttgttatgccactcgtgctcttcttctcccttaactctaacagcggaaacggtgacggccgtggttggtttggcttcgccgctactgtggccatcatcgccgctgtaacgtcaattggggtggggatcttcacccacgaaaagaagaacgaacttcgtaacaacaccgaaagcacctcctttgggaaggttttaggcgtcttagttaaaaacgaccaattaatggcgatcgctttaacctacgtcctctacaccaccgggattcaaatcatgaattccttccaactctactacttcacctacatcatggggaaagcaccaacctacacgatctacgctttgatcaacgggttaatcggggtcatcaccgtttccctcttccctggcttggctaagaagttcagccggcgtcgggtcttcttctactccatcttagtaatgctgatcgggctggtactcttcgccttggccggtcactccttaccaatggttatccttggtggggccatcttcatgctgccacaaccactgatcttcctggttgttttgatgatcatcaccgactccgttgaatacggtcaattaaagcttggtcaccgtgacgaagggttaaccctttccgttcggccactgcttgacaagttcggtggtgccgttgccggtggtgtggttgggatgaccgctaccgctgccgggatgatttccggggctactgctgaccaaatcaccgcccacgggacgtccatcttcaagctgattatgtttgccgttccagccatcctgatcttactggggacctttgtcttctcccgcaaggttaagctggacgaaaagatgcacgcccaaatcgttgacgaactggaaaagacttggcaccaacacctggaaggtgacgactccgcccttagcgaaacggctatcgctgaaaccgccgcttccctctccttcgccgctccggttgacggaaagctcttaccattaaacagcgtttccgccccagcctttgccaacggctcgatgggtgaagggattgccatcaagcctaccgatggccaaatcttcgcaccggtggccgggacgatcgtcgctgacttcccaagcacccgtcacgccctcgggatccggaccgataacgggattccgttcttgatccacgtcggggtcgacacggttgaaatgcaagggactggcttcgtctcctacgtcgaaaacggtcaacacgttgaagccggcgacaagctgatggaattctggtccccagccattaaggaagcgggccacgacgacaccgtcatgatcgccttcaccaagtctgatgacacaccaaactacgagctcaagttcgtaaagaacgaaggcctcgttgatcacggtgacgaaattattcagatcgaaaataagtaatccacctttaaaccggggggccgcgactgtcagcgtcacggtcccccctttttcattaagaaaggaagttcattcatgccagtctttatcaacgaagagaccaagctcttccacttacaaaccaagaacactagctacatcttccaaatcctcgctaacgaggcggcgggacaggtttattacggcgccaaggttccggttaagccttcctattccaacctaatgacgatggaagaacacgactgcaccaacaccctgtcggaagaaaacacttccttccaactcgaactggttaaacaagaatacgccacccagggtaagggggacttccgcgaggccgcctacgttatccaatacccagacggctcccggaccagcgaatttgaataccagggttaccaagtcgaagaggggaaaaagcgcctgccgggtctgccatcttcgtttgacgacgaaggaacggacgccaccagcctgacggtcactttcaaggaccgcctctacgatttgacgatgaacctgcactacacggtctttaacgatgacgacgtaattgttcgctcagctagctttgaaaataagggtgacaccgtcatgatcgatcgggccctgtccgctcaacttgacttgccggacgacaattatgacctcctacaattctccgggacctgggctcgcgaacgtcacttataccgcaaccacctgcggccggggatccaaagcgtggccagtcggcggatcaactccagccaccacgaaaacccggccatcatcttagcccggccaaacaccgataataatcagggtgaagcctttggttttaacctagtttactccgggagtttcttagacacggttgaggttgaccagtttaacaccacccgggtcgttaccgggattcaccccgatgacttctcctggcaactagaagccggccaatccttccagaccccagaagcggttctttcctataccaacgccggcatgaacgccctcagccagcaaatgggccgcttctaccgtgaccacttaattaacccccactttgctaaggaagaccggccaatcctaatcaacaactgggaagccaccttcatggactttaccgaagaaaaactgatgaagatcgtcactaaggctaaggaaaccgggatcgaaatgtttgtcttagatgacggttggttcgggcaccgtgataacgacctgactagcctgggggactggttcgttgaccaaaagaagttcttaaacggggtcggcggctttgccagccgggtgcacaagttggggatgaagtttggcctctggtttgaaccagaaatgatctcaattgactccaagctctacgaagaccaccccgactggatgatccaaactaagggacggctagccaccccggcccgccaccaattcgtcctcgacatggcccgccaagaagtcgtcgatgacatcttcaacaagatgagcgccgtgattaaagacaccaagcttgactacatcaagtgggacatgaaccggacgatcaccgaggccttcaccactaccctgccggctaatcgccaacaagaatttgcccaccgctacatcctcggggtttaccaactctacgaacgcctaacgcaggccttcccgagcgtcctctttgaatcctgcgcctccggtggtggccgcttcgacctcgggatgatgtactacgccccacaagcctggtgctctgacgacaccgacgccgtggaacggatctacatccaagacgggacctcctacggttacattccgtccatgtggggggcccacgtttcggccgtgccaaacgaccaggtcggccgcgtcacttccctagacacccgggccaaggtggcctacttcggtgcctttggttacgaactggacttaaacgaactgtcagaagaagagcaggaaacggttaaagaacaagtcgccttttacaagcagcaccgccacctcttccaacacgggaccttctaccggattgacagtccagacaccgctaccgataacgtctacggctggcaagtggtcaatgacgaccagtccgaagccatcgccgtgcgcttccagatcctcaatgaacccaacccgggttacatccgcttctactttaccggcttagacccggaaaagacctaccaagttaacgacgacgaggaaacttactctggtgcagaactgatgaacgccggttacttcgtggctcggatcatgccacgctcggcctcgccaaagccgctggccgactttaacgccaccatgtttgtggttaaggccgtcgactaagccgctaacttacttacactccttctaaatcaacagcccctcccgagccaggaggggctgttttagtatcgcaaaaataggtggaaaataagattatagatgaaaacggacgaacagttggcgcgtaagacccggttcttcggtcgtttgtatctgtttcccacacaaaagggccgtgacgaatttgtcacggccctttttgtattgattggcattatgaattggtttcttctggtggcgtactttggcgtagcatcaacctagttccgaccaccacccgctggggagcgagttcgctatcggcgagccgccgtcctagcaattcgatggctacgctcgccatctggtcggtggcaacgtgaaccgccgacagggccggatagaggttacaagtaaccgattcgatatcgttaaaggagaccaaagcaatctggtctggaatgaccacgtgggcctcgtgtaaggcgcgtaaagcccccacggccatcgcatcgttggtaaccatcactgcatcgagggactcggggcccgccaagagctccttcatcgccttgtaaccaccgtcaacggtgtagttttcgaccttaaccagcttggggttataacgctcgcggtccttcaaagcgtttaagaaggtcttttcccgcacgtcgcggacccgctggccgtcggtagttaattcgagaccggcaatcagaccgatgttttggtaatgggtggtcaagtagccggccgcctggttcatcccgccgacaaaatcgggcaagacacagtcgaggccgcccaccaaaacgtcgtagtccaccaccaccacggccggggttagtttttcaaacaagtggagctggtgaccggaaaacttcccgatcgccacgatcccgtcaatatcttggggaatctgatccatgttgttttcaaagacggtcatcgtcatgaagccggcttgctgggccgcctgttcaacgttcatccggacgctcatgtagtagatatcgtcgagttcgcgctcggccgaataccactgaacaatggcgatccgtcgtcccgtcacttgggacttcggtcgcttagtgtaggaaagctgttcggcgatcgaaataattttgcggcgggtttccaccgataccgatagccgcgggtcgttgttgagcacccgggagacggtggccaaggaaacccccgctcggttcgcgatgtctttaagggtaactgccattagttccacctccacgggtcataaatcttatagttgcttaataaatcgttgccagccagcgtcgccttcgtccgtacgcttgaagaccccagcgtcctctaatacatcggagaagacctgggcgagttcttcttctaagaccgcctccacgttggccgacataatgtcgcggcgtgcggcgacctcctgggcccacggcaggtgcgctggggcaatttggttatcttcatttaaccagaatttcttaacttcttccagttcaaccttcagccgggccggcaagattgcccgccccatcacttcaatcaggccaatgttttccttcttgatgtgccacagcttttcgtgcgggtggaagattcctagtgggtactcgtcgctagtgttgttgtcacgtaagacgaggtctaagacaaaggtctcccctccccggtgcatgatcggggttacggtgtgatggcgggtgccgtcttgcccggtggccacaatcgaaagcgccggatcgctgtagtcgttccaggtcttcatgatgtgtgtccccaggttgatgagggcgagctggtcggtcgtttccaggcggatgtctgacattggccagtcaacgatgccggccttgacctgcgggtagtccttaaaggtcagttcctgcttaatcggggccttcatcatcgggaaggtgtggcggccaccttggtagtgctcgtgggccagcattgaacccccgacaattggcaggtcggcgttggagcccacgaagtagtgcggcagggtcttttcgatctcgactaagttgaccagggtttgttgatcgatcttcattggctcgtgctggaggtccaagaagatgcagtgttcatggaagtaagcgtacggtgagtactggaagccccaacccttaccgccgatcatcatccggataacccggtgattactgcgggccgcctggcctaagcatcctaggtagccctcgttttcaatgcacagggcgcactgggggtactttttggccgtatcgtgggccgccgccgcaatcgccttggggtccttttccggcttggataaattaatggtgatttccagctcgttaccatccttgacctgccgggtaaactcgacgttctttttaatggccgctaccttaacgtagtcgttttcggtacaaagttggtagaaccaaccagtggcggcttccggggaacgttggtattcctgccagaagcgggcgttaacggcggacggcgtgggggtcagcaagtcaaagagctgctcgtttaagatttcccgctcggtttgtccgtcttcaatcttaccgttttcaatcgataagtcaaccagctgctcggcaattgaccgcccggcttgcacgtccccgtcctgatcgccgactaaagcacgcaccttgttggccacgtagaccttgtccaacggttggtaagcaccgcttgcaatcgccttttcggcaaaggtttcaattagtcccatgatctcaaacccttctctcttctctgcttacagcttgtgtggaccgtcaacgatttcggcgtcgtagaaggaggcgtcgtagccgaccttctcacggtagatttcgccaaccttttgcttcaggttttcggcctggtccttcttaacgatggcgatggcggagccggcaaagcccccaccgatcatccgggcgcccaaaacgcctggttgttgccaagcggcttcggctaaagtgtctaattcagtcccggagacttcgtaatcgaagtgcaaggagacgtgggaggcgttgatcagccggcccagcttttcgaggtcgccgtcggtcatcgccttagtggcttggatcgtccgttggttttcaaagacggcgtggcgggtccgcttgagcagggtttcatcgtttaagaggtagctgtattcgtcgaaggtgtcttcgtcgatttcgcccagtgagttgatgtcgagcttggtttgcaggcgctttagggcttcgccacattcagctacccggtcgttgtaagcggaagcggctagggagtgcttcttgttggtcgacatgatcacgatttcgtaatcgcccagttccagcggcatgtacttgtattccagggtgttgcagtcgaggaagatggcgttgtccttcttccccatccccacggcaaactggtccatgatcccggagtttaagccgacaaagtcattttcggtcttttggcccaacttcaccaggtcaatttggtcgatgtccaggttaaattcgtcctttaaaacttggcccattagcatttcgattgaagcggatgaagaaaggccggccccgtacgggaggttcccgtaaacgtagaggttaaaaccgtggtcaatcttaaagcccttttgacgcaggtaaaccaacattcccttgaagtagttagcccacttgcggtcttctgcttcttccggtgcttcgtccgtaatggcaaaggaaaccacgtcgccttccatattaccggagaagagttgcacctggtcgtcatcgcgggcgccgtacacgccgtaagtccccaaagaaattgcacacgggaagacgtgaccaccgttgtagtcggtgtgttccccgatcacgttgatccggcccggggagaagaagaggtcttggccctgcgctgcaaaggtgtcttggtacttgtcaaaaagctcttgttgattcatgtttgtttgccccatttctttgttagtaaaaaacaagtaaaacttttaccattcttatgctactatcacccggtttattagtcaatagagcgcttacattttttaccaatagctaatgaaagcacctaccgccgcaacgtgctatcataggggctaaacgggagggattggatgactaaactttttaccccgactgaggtggctgaaggcagcttgctcctggggcgctggcaattgcaaaatgacgaactctacaccccactcctaggcggagtgattaaaacgatcgtcaccggcagcgaccagctgactttaacggtcgctaaccgccaccacccgcttatgcccagccactactgggcggtgcgggtcaaccacacggcgtggcgccgctatagtgctgctctccctatcgaagtcgccttacccgccgagcgcaacctcgttgagatcatgaccgccggtaataccgacctcgacgacgtctggtccggtaaccaaggctttgccctcaccaagctcgaactgaagggcgccggccggttaattaaaccaagtccccgcccggtcgtagccatctacggcgattcaatcaccgctggctgctgggtcaacggctacggcgccagcagcgactaccgcccggaacaaaactttgtcggcctggcccaggacaaaatcgacgtcgacctcgcccgggttgcctactcggccgccggggtcttgcgcccggctaccgggggtgttccggtcgccatcgactggctcgaccatttcaacgcccaaacgccttggccgccccacccggttagtctgtcggtcatcaacctcggggttaacgaccggcgctttagcgaggccgactttgcgaccgcctacgaacaatacgtgaccgcctttttaaagcgccaaactggtccggtcgccctgatgatcccctttgcccagagcatggcaaacgtcatccgggccactgcccagtaccaccagctccccgttatcgaaacgaccggctggtgtgcgagtttcaccgatggccttcaccccgacctaaccggtgctcagcaagcggcgccccgctttgccaaggccctcacccgcctactcaatgaaaggatgtgaccaccgtgtctttaaatcgcctgttaccaattaaagccggccacaacttccgcgaactcgggggctaccagaccaccgatggccgccaagttcagtggcaccgcctgatccgggccggcgccctcggccagctttcggaggctgatttagccctcttagcccagctaaacgtgaccgccgacatcgactttcgttcccccactgaattagaggcggccgccgatcgggtcccccacacggccacttatcaccacgaaccggtctttgacaccgaccggaccgagtcatccaagaccaacgccgaactggagcccctcttagtggccgacccggacagtggtgcccgccacatggaggtcacctaccaggagatggttaccgagccgacctctaagacggcctaccaacacttcttcgcccacctactggcgacccctagcgacggggcggtcctctttcactgcaccgccggtaaggaccggaccggggtcggcgccttcttgttgctctcggccctcggcgtcgatgccaagacgatcgaacaagattacctgctgactaaccaggtcaacgaggcctttgtcaacgaactgctgcagcgctttgcttccgccggcaaaaacgagacttacgtccataacttccggtcactagccaccgtttcgccccgctacctcaacgccaccaagcaggccatcgctacccattacggcacggttaacgactttttaaccaccggcctggggctcagtgctggcgacctggccgacctcaaacaactctacctcgtttaatagaaaggaagttttttcatgcgcatttccgttcccctgactaaagaagggctcctcgccgatcaatatggtaagttcgccccggccagcgatatgctagccgatcacccggtccgctccttccccattgaaattgcggacgtcccagccggcactgaaagcctggccctgaccttcgtcgattttgattccaccccggtttgtggctttacctggattcactggctagccgctaacttcccggccaacaccaccctaattggcgatgacgctagccgcaaggacggtcacggttttgtccagggcaaaaacagtaacgccggccgcctggttaacggcgacccggccattaccaagggctacgtcggtccccaaccgccggaccagatccacgactacaccctaaccgtttacgccttagacaccaccctcgaccttaatgagggctactggctcaacgagttccgccatgctgccaagggtcacgtcttagaaaaggtcagcctagagctgccgagccgcgctaattaaggaggaattaccatggataaccggattttcttcaaccccggcgactcgatcgccaacatccacgactacaacgaagccgtccgcaagggtcaaatcttcaaaaaggaacagcaggccggcgacctcgtgatcgctaagggtcccgatgacgaagaatacgccatcttctacgccaacgatgccctgcccgccgaccacgagcaatcccaaccctacgagattaagaaaaacctctaagcaaaaagagtagccccagacaggctgctctttttgcttagttttatcgaattggcaacagtgcagtacgccagtgggagcgacgacgaaatcaaagatttctgtcgccctccccctaaaattccatcgccgccaagaattccttgatccgcggcgttgggtggttaaagaagtcatcggccgacccggtgaagtcaacccggccgtcttcgacaaagacgatcttgtcggccacccggcgggcaaattccatgttgtgagtcaccacaattaaggaatcgccgtcgttggccaactgctggaggacccgcaggacctgggcctctaactcggggtccagggcactagtcggctcgtcaaagaggatgtaggccgggtccattgctaacgcccggcaaatcgaaatccgttgctgctgccccccggataattgacccgggtaacggttggcagtgtcgtctaacccgacttttttcaagagctcgtgggccttttgtttggccttgtccgggtcctgcttgaggacgtgaattggcccctcggtgatgttttgcaggatcgttaggtgcgggaagaggttccagctttgaaagaccatcgccgttttttggcgcaccgctaggatttccttgttagtcaaattggcgccgtaatcaatcgtgacgtcatcgatcgtcagggtgccggattggggccgctccaagaggttcaaggaccgtaaaagcgtcgacttcccggcccccgacggccccaaaataaccgtcgtttggtgttctgcaaagtcaaccgtcacgtcatctaaggcgtggtggtcgcggtaggctttatcaacgtgttctaacttaatcatcttattcccccacggcgtccacgtaccgggacgtccacttctctaagtagtgctgcaggatgctcaaaacggtacagaagagggcgtaaatcgcggccacaattgagtacatcaggagcggttggtagttgttagaggcgatctgttggctgaccataaacatttccacgatcgtaatcgaactggccaaggacgtgtccttcaccaaaccgataaaggagttggacagcggcggcagggccacccgcaaggcctggggaaagacaatccgaaacagggcctggcggtaggtcatcccaatcgagtaggccgcgtcccactggctgtccggaatcgacagcagggcaccgcgaatcgtttcggaagcgtaggccccggtgttcaaagaaaaggtaatgatcccagccgtccaggcgttaaactggatgcccacgttaggcaaaccaaagaagacgatgaataactgaaccaagaggggcgttgaccggaataaccagacgtaaaaggaaaagaccgcccgcacaacggcccacacggccttgaactttccctggggttttgaaatccgaatcaaagcggtaatgacggcgatcaccaacccaatcacaaaggagatgatggcgatcggaatcgtgtatttaatccccgcccaaaaaatctccggggtggagcttttaatgatatcccacataagtttcctttctacatgtataaagcaaggggccctagtaaccggcactagccggccaaactagggcccgatgacgacaatttggagacggttagtcccgacttacttatcagtaatgttaccgtggaagtacttttcggacagcttcttgagcgtgccatccttacgtaattcagctaaggccttgttgaccttggtttgcaagcccttgttgttcttggccatcaggaccccaatcttttgaactgggatcttagacgacggaacttcttggtacttgaggtcagttgccccggtggacttttggtagtacaagaaggcttccttagagttcaaggctgcttcggcccgcccttggcgaaccagttccatggccgtggagaagtcggtggatgacaccgtctccccgccgaacttcttcacgttttgggcgttagccgttcccgtggcggcggcaatcttcttgcccttgatgtcatcgatactcttaatcgtggtgttgtcagacttcataatcaatgccgacttggagtaaatgtacggcgttgagaataagtaagacttttggcgttccggcgtcatagcaatgtcgttgatggccatgtcaaacttcttggagccgaccccagcaatcaaggagtcccacttagtcggaacaaacttaaccttgtaacccatcttctttgccaggtcgcgggccagatctacttcaaacccggttaacttaccgttttcccggtaggagtacggggcgtaggttccttccagcccgaccgtcaacgtccccttggttaccagttggggcttgctagacgatgagctgctcttcccacaggccgctaatgccaccatagcaaccaggctagcagcgaccacactcaatcgtttcatccacttcttcattgtaaagaagcctcctcaatcattttcttcgggttcacttacaaaagtaagcaacttacctttagtaactataacaaggcaagttaggtacgtcaaagaaaaaccgttagaaaattttaatttttgctaatggcttacttaccggccgcccacgatccgttcggcggcgatttccaaacgttcaatcagggcgtcggcattttgctcaaagtcggtgttaaagtcggcaccctctggcgccaccgtccccacttcttcgcccataaaatcggtcacgactagggtttggtcccgccaagccacgtcgtcgtagtggccctctaaggcttcatccataaaggattgcatcaggtccaagacggcggttttaatgacctcatctttagtcaggctagttccccgcacttgggcttgggcgatcttcatcgctacttcttccatgttagttggaatctcaatactcattttgttatcaccttcaattgaaatcttcccttcatcatatcataattaggctaagaaaccgttttgattggtcccaatcaaaagctgaaaggatgaatactatgagcgcgaccgtattagttcccacctacctcgccaagacgggctacgaagtcctccaacaggcggggctcaacatcatcgaagttcccaacgtcgataacgccaccctcctcaagtatcaggatgaagcggcgggcgccattatgggtgtgtcaccaattgacgaccaaacctatgcccaaatgaaacagttgaagatcttggcccggatcggggttggtttcgacagcctcaacccggttgaagccgctaagcacggcatcgtggtgaccatcaccccccactccaacgccatttcggtggccgagtcaacaatcggcgccctgttaaacctctccaaggatctcccccaacgaacggccctgatgcgtgccggtaagtggcgggaagctaaccaggcccagggtcacgacatcgacggcaaggtaatcgggattatcggttacggccggatcggtcacgaagttgaaaaacgggccgccgccctcgggatgcgggtgctgattaacaacggtaaccggccgaaagtccctgaaatcggggcgccggttgcccttgatgagctactggagaagtctgattacatcaccctgtccacccgggtgacggccaaaactactcacctgattaacgccaccaccctggccaagatgaaggacaccgcgtccatcatcaactttggccgtggcgccttggtcgacaccgacgcgttgattgaggctttaaagaccggggtcattcactcggccgccctcgacgtctttgaagaagagccgctacccaccagctccgaactttacaaactcgataacgtcttactcagtccccacatcggcggtgggaccattgaggcgatggaccggggtagctggggcgcggctaccgaggtcgttcgcgtcttggccggccaagaaccccgctgggccgttcgtcgctaaaatggctaagatttactaccaggagatgacgccggcgggctaccgggccatcgaagaacaaatcaaagcactcaaacaaaagcgaccgaccctgatcacccgtctaaaggcggcccgcgccctgggtgacctctcggaaaacaccgagtactcaacggccaaacgggagctgcgccacttagaaagccgcctgcgctacctcgacaagcagctaacctacgccaaggtgattgacgtctcagacgatggcaaggtggccctggggaaagtggtcacgatccgctttttggacgaccaagaagaggcgacctaccaaatcgtggggcgccaccaggccgaacaggcttccttaactgaagaggttttggccttcgactcccccctggggctagccctcaaggggcacaccgccggtaccaccgtgaccgtccacgccccagcggccagttaccaagtcaccatcatcaccgtaaaggtgaagtaactttactagccgtcaccaaagaaaatttaaaactccttcaaggcggggcgctccccctttaacccggttaatcacttgattgaccgggctttttttacttgccctcacttccaaagaccgctatactatttaccgttgcgccaaaacattaacacaagatcttgtaaattaggcgactatcattaccacatcttgtggttagaaaagagcgattacatgtttgatcagtataaagatgtcttaacccaccttccccagtactccaagaatatcttccgccccggctacttctcctggctagttggccagatgaagaactggagcaccttttcttggtacctggtggcctttaacttcattgtccaagtggtcttaatgatccagggttgggctagcgtacccgtctctcactccatcatcagctttttgtccgccaacctgagcgtattgtgcgtggtcgggatctccaataagtcggccatccagggctggtttggcctcacctcggcggtctttatcgccttaaacgcctacttggcccacaactttgccgacatgaccctgcaaatcttttacatcatcttcttggacctcttttgcattttgtcgccgtcctggaacgataacgtcaaggtccactcgatgggtggcgtcaagggctggctcaagtacctgctcttgttcgtcgtcttatggggtctgatttactacctgtacggcttgattaacgatccccgcctcttcttggactccttaaccttggcaatctctttgacggccgccgtaatggaattcaacctgcttcgccaacagtactacctctggacgcttggcagcatcatcacgatcggcctctggttacaaaccgccctgcaaggtgccgccaactacgccttggtggcttcctacctggtctttttgctaaacgacctgtacgccttcttcggtagccagggttggttcgtgaagcaagaagtcgtcaccggctacggccaaaaggaatccaattaaatagcgggggaaatggcctctagggtgggcctagcctgcctaacattcggatacacagcgagggccccggagaaaaccatgttttctctggggccctcttttggggttaattttgctccagcgcccgctggtaagccgcgtaagttcgcgcgtcaaagcacaccatcgtcacccggtcgagctgggaattatttcccaggaaatgttgaatcgtcgcaatggctaagggcgccgcttggtcaagcgggtaggcgtaaaccccggtggaaatggaaggaaaggccaccgtgcgacagccgttggcaaccgctagttggaggctgttgcgatatgagttcgctaacaggctggcctcgtgatgatggcccccctgccaaactggccccggggtatggatgataaaggtggccggtaagttaaaacccggcgtgatccgggcctcgccggtcgcgcacccaccaaacttagcacaagccacatctaaacctggtccggccgcccggtgaatcgccccgtcaaccccgcccccgccacgcagggtggtattagcggcgttgacaatcgcatccacctttaacttagtaatgtcaccttgggttacttctattcggcccatttaatcacctaccaaatttgaacccggtcggcgggcgccttgtacatggcgtcgccgtccttgacgtcaaaggcttggtagaagtcagccaggttttgcacctggacgttggcccgcagcttgttcggggcgtgcacgtcaacggacagaagtagttgttggtactgttcgtgggccttcatccgccagatccgggcccagttggtgaagaaggccaccggatcgtaatccgcttcttgcttagcggcggccaaggcgcacgataagcccccggcgtcggcaatgttttcggagacggtcagcttcccgttgacctgttgcccggcaaacggcaggccatcaaattccttaatcatgtcttgggccaggtccttgaagtgggcctggtcctcttcggtccaccagttatttaggttcccgaattcatcaaagagggcgccgttattatcaaaggcgtgtgagatttcgtgggcaatcacggccccgatcccgccgtagttttcgctggccgattgcttgaggctgtagaacggcgcctgcaaaatggcggccgggaagacgattatgttcataaacgggtggtagtaggcgttaacggtggccgcactcatttcccagcgggtcttatcaacgggctggccaaagcggcggaagttttcggcagccgccaccttgtttaattcatccaacgcccccattaggtttaagccgtcgctaaccttgagttggtcgtaaacagccggcaacttagccgggtaaccaacctgaaccccgaggctgtcgagcttaacgatggccttttgccgggtcgccggggagagccaatcgttttcctctaggcgctgtttgtaaacggcaatcatttggtgaaccatgtgctccacgtctgccttagcggccgggccaaagtaggtttccccgtaatacttaccgattacctggccgaagtagctcatcgtcaggtagtaggcaaacttctcgtggttgacggcttccttggacccggaaagggcgcgggaatattcaccacccaagatccgcaactcatcggtcactaacgaggcgttaccggtgacggtcttggccaacagccagctcttaaagagggcgaagtggtcggtcaaaatttcgtttaaggccgccaggtagttcggttcggtcacgatcaccttggcgggttcggtccccaccaatccgctcaccatcttagctaggtcgagttggtcggtcgccttggtaaagtccgcccaagcgacagggttgtacatcttagcgtaatcagcccgttcttcggccgacttaacgtgaggcactagcagggcgtcgaattgcttcgcttcttcggtgacctggtgggcttcctccgccgagtagcccaccttaacgaacagtttttccaccatttgtgaccacagggccagaagttgcgggccctgcggattatcctcttggtagtaacccttttccggtaagatcaggctgggggcgccaaagaagagcccgtattcggtggcttttttcatgtccgggtcgatgtcaaaggagaccgggctcccctttcccaacagggcccattccggccacttagcggagtaatcggcgtagctggtcagggccgccacttcgtctagttccttgactaagggggccaccccttctgtttcgcgccggtcaaagtccttagctaaggcatacagcttcacggcctcttgcaaccgggcgtttgggacgtccttttgcccagcggccatcgcatttaaatcaccaatcagggtctcttcgacgtctttgaccaggtcgttaaagcccccggtcgccggacggtcggccggaatttgggcggtctgttcccattccccgttcaccgcttcgtacaggtcggcttttaccgcacccttctcaacttgtgtcatcttctcgcatcctttccaagcgtttatgttcattataaccgagcacacaaaaagaggctgggattttatccccagcccctggttagtctctattcataaaattcaacggcctgccgagtaggttggttcccacttcctacttaacgtttaagatccacataaagccgatgaagatgaagaagagggcgtacatgatcgggtggacttccttcccccgcttagccgcaatcatcgtaattgggtacatgatcaaccctagggccatcccgtcggaaatgctgtaagtcagcggcatccccaccacgatcaggaaggatgggatggcgatctctaagtgactccagttaatttgacgcagattttgggccattaagaccccgacgatgattaaagccggcgccgttacctggtcggttaccacggccagcagtggcgagaagaacatcccaaagatgaagagaatcccggtcaccacggcggtgaaaccagagcggcccccgacggcaatcccagccgaagattcaacgtaggccccgactggcgaggtccccaacacggaaccggctaacatggccgtcgagtcagacatcagggccttgccgacccggggcatcttgttgtccttcatgaaaccagcttgttgggccaagccgactagggtgccggcggtgtcaaagaaggtcaccaagaggaaggtcaaaaccaccacccacatttgcagggtgttaatttcgccgatgtgggtcaaagcaaccccgaaggttggcttcaggctcggggcggccgatacaatcccgtgtggcacgggaatcaggccggttaccaacccaacaaccgccgtcaccaccatcccgataaagatggctccgggtacccggcgcaccattaagaccgccgttaccactaagccgaccaccgttaaccaagtgctagcggtcgtaaaggaacctaatccaaccacggtggacttgttggcaaccaccaagcccccttggtgtaagccaatgaaggcgataaagaggccgatcccagcggagatggcaaactttaggtcggacggaatcgcgtcgatgatgatttcgcgcagcttaaagattgtgatcaaaacaaagatgatcgaggccacaaaaaccccggccaaggccgtttgccaactgatccccatcccaatgacggcggagtaggcaaagaaggcgttaatcccgagcgccggtgccgtcgcgattgggtagcgggcgaggatccccatcaaaaaacaccccaaggcagaggccaaggcggtggcggtaaagaccgccccggtatccatcttggcggcgccgagaacgttcgggttcacgaagaggatatacgacatcgagatgaaggtcgtaaaaccggctaaaatctcccgccggtaatcggtccccagctcttcaaagtggaaatacttgctaattgcagacacaattgatcccccattttatagaatgaacgaataaaatcacgatgaatatcatataatattcggctttcaatgtaaaggggcgatccgaactttcttttagtcagcaaagggggctaacagcgccgctttgccccccgcactcaaccagccgccgtggtgggcgactagctgggcgcaggaacgatagtcagccaggttaaccttgccagccacgatcccgtttgcttgtaaccgccgggccaactggacgtcatcagcggtcaccaagtcgttgacgagcgcgttggggcgggtttcccagcccaagttaagcagggcccgggcccgctgatcggctcggtcgtgggtcagggcgtgggctaagtcagttggttgcaacatttcaatcatcctttcttaggtgaaagcagctaccaggcggatcttgcaccgagagcttggcgccggtcgtcaaaagccacaggacgttttggtaggggcgagcgtcaagttcttcttctccggcaccatcggtcaaaattagaattggcgtggttgggataacccggcgcacccttaggtcctcaaagatggcggcaaagcgggttcccccacccccaagacgccgcaactgcccaactgccagccgtccctgaatcgccgcatcaaaggcagttaggtggacctgccagccctgttggtggaccagcgccaccaccattttaagcaagcgtgcgacggtggcatcgcccatcgaaccggactgatcgacaaagatttccaccggggtcactaggcggctaacccgtcccggcaagtccatccggtagggttggcggcggttaaagcgggcaaaggaggctcgttgcccgtcaatggcggtccccatcaagcggcgcagggcccggacccaatcggtttggtagctaccggacggctccgttaatccttggtcttgcccctgaggaaccgtcccacgcccccgctgatcaaagtggggcgcccgtcccttggtgagtcgctttaagcttgccttcattagtaaggggttagcccccgccggcgttacccaggccgggatgggccgctctccacccacccctctccccaccaactgacgcttagtggcgggagctagggcccgggcggccggtaagtaggcggcggaatcggctaggcggggcagccgttgcttggtcgcccgttccaggtcgactagggtgaccgtcccggctggcgactcttctaggtactggttaacggcaacatccgtggcaattgccaccgccgccggatcgaaggcgtcacggtagcggtatgggtggtaccagagcacgtggagggctaagtgatggagtaaattagtcagctcccgtagcggttcctctttaacccaggctgggttgtacgccaagacgaggtcatttgactgccaaatcaggttgagcgtggactgcaaagggtcggaaattcgtttaatgttgactaataccaccccagcgctatggtccttttttaacaggtcaattaccgccgcttgcaactggcgctccccctcaaccattgccggtgccccgcttggcaatttccgccagtaattcatacatagcgcgagccgccttatcatcccgcgcctggtaaagcgccgccagcagatcggcccgcttaccaatttggtagcccgccgccacttgcccatccgcactgagggacttgagaagggtcaccacccgtggcaaagtcgctaggtccagtggcaccgcttgccccagccactggttgaccaggtcgaggcgattactttccggcaggggggccaccatctcggtgaccggagacggggcggataacagttcttcaattcccaccgcgggcgtcaaaataacctgggccaaatcaacccccacttcttcgcctaagtccccagctaagacgtcggccaacaccgccctggattgagcggccgggagtttccttagggacgttaggttgcggctggctcgttcccaagagcgcggcgtcggcatgatttgaccgaccaccggagccggtgctaagagattcgggtgctctcgcaggtagtcaaccaccactggttgcacccggggggtcccgtcaacttccccttcggcccaagtaagccagtcagttaggttggcccgcatttttaggcgaacggttcggtcacgaacggcggcgtcactgggggtcacggcgtaatcgccggccgcatccatcgttgggtccgggttttgggctagaataatgtgaacctcttcgggcagggtcagggtgtggatctgacgttgcgaaaccaggttcatcaactcactttgcacggcggcgtttccgcggttaaactcgtctaaaaaccaaataattggttgccccgggcgggcttcagcctccttaagcagggtaagcaaagtagttgagtagccgtacttaacgtcggcgagcgtcccgaagcgactggtggtcactaggctgtccttggttaaaggcggtactggtaaggccagatcccccttttcggccaggctaacgacggtggtcaacagggtggcgcccattcgtttagccacctcggctaccaacgcggacttgccaatcccggcttccccaaccaggttaggtacgctcccggcctcaagcagggccggcagggttaccagtagttcttggtaggttaaagacatttcaatccccccatccgtggttaaccaggtcagaatcgcgctttagcatcttggaaacgtaggggttgtggtcgacaaagaagcgcaacggggcgttaccgttgctccccctttggttgacccccacccgggaactgaccccaatcgattggggcgcccgccgcttggttaaatcaatcgaaagcggcgccgtttctagcggctgaccatctaagtggcgatccactaaccccagggcctgcccaaccttgccgggcccgttagttaagttcaccccgacctgatgacggcgctcctccattaattcaagcccctccgtgggctctagtgcccgaatcaaaattccctggggttcttcttggtcttgcacgaccacgtcaaagcagtagtgagcccggatttggtagacgtagatcgttcctggcgccccgtacagggcctcggaatagttggtccgccgcccgttgtaggcgtgggaagccgaatcctgctcacccaagtacgcctcggtttcaacaatcaagcccgccactctccccgcggggctttggtaactgagttcacgccccaagaggtccttggcgatctcttcggtagggcgattcgtgaaaaaggcttggtatggtgacatttggtttcctccactgataattaggattatgataagggtacgaacagaaaggacgggatataatggcattaaaactagaacggatttacacccaacccgccgacctggacggctaccggattctggttgaccgcctctggccccgcggtatgtcaaaggaaaaggcccacctagacgagtggctaaaagaggttggcccaaccaagaagttgcgccagtggttcaaccacgaaccggccaagttcccggactttaaggctcaatacctagcggaactagccgccaacccggcctttgcaaccctcgagcagaccgtcgccgaccacttaaaggacggcaacgtgatcctcttgtacggggccaaggacccggtccacaaccaagcggtgatcctaaaggaaaagttggaagccggcctcggcctgtaatacgtttattttagcgcgccgctgggaaaagaccaaggaaggtcaaagaagtgcgatccaatctatcaaacaggccttacgactaagctagggtgaaggttggtgccttggcaccgttcttcacccgtacttaagtactaggtctgtggtcatttccacgttatcaaaagtgcgatccaaccattggcaggccgtgagctaaggaaaggttgggggttgatgcggtacgcaaaaaagagcctaggagaaaagatttctcttagactcttttagtttagtctccattccctaattgctccgcttgcctccccaagcgcgaccgtccagctccccggccgctagcgttaagcggtggtcttgttcttcaatcgtctgtaaggttgctaagagcagggcccgctccccttcatccgtgctcttctccgttagttcgttcacctggtgtttaaccccaagccatggttgcttcgtccatttaatcatcccccaacaggtctaagtttaggcgtaagtcactgagttggtcagtattatcttccaagaccgccgctaaccctaggtaacccggtgcccgatcggggtgttgctcagccaacttccgcaggcggcttgctaaccaggccgcctggtcggctaagtgcccgggccggggtgccgtcaggtactggcggtagttaacaaggagctcctggcgctcccgctcagtcaaataagcaaactggcccacgaccagcggggtcaggtaggtcatcttagtttcgttggccaacgcctgcagtggacgcagcagctccgctagcgtaaaggactgaccctgccccggcgcaaaatccttcagggcccggccagtattgaccaccagcccgagctccttgcccgctagccggtcgccagccgctccgagcaagtcatcgtcaaagacctcatctagccaggccttcatcaccgccgggacgctgtaccaatagaggggaaattcaaagatgatccggtcggcagcccaaagcaaggcccgctccgccccacggtcaaagggcgccactaaggggtgccaagtaacccctgcttcttgcttggcggcgtgcttgaaaaaaccttgggtgctcgaagtggctacatccgggtgacccatcacgactaaggttttcattattaaccctcctttaaaagggtgcgcccttgttcaaccaagcctggttccgccatcgccaccaagaagcgctggagaggcacttcctggtggcggtccttaaaggccattggctcggcggccacgatcatcaccagcaggttgttttccgtcagcatcagctggccgatcccggtgtacttaccccgggtgtgcttaccggtccgccagacgtggagcttggcggccccactggcgtcacgctttaattggtagccaccgttaccatcgttttcgaccggcacgcccgtgtaacgcgtaaccgggtattgattcttctttgccatgtttcctcctttggttaaccgtcctccaccccgcttgtattcgcttgcacaaagttattttctgtgctttgataggggcaaaggagtgatcttatgactgaacaagcaattaccgccgcccaaatgcgggccaaggaccaattcacgatcaaccagattgggatcccatccctggtgctaatggaacgggcctcgctcgccgttcgtgacgtcattttaacccactacccggcggccaacaagattgttgtcgttgccggtcagggcaacaacgggggcgatgggcttgccattgcccgccttttgcacgttgccgggcggggcgtggccattttaaccattggcaactccgcccacgcttccagcgaacaccaaacccaggcccacatctgcgactactaccaaattccggtcgccagcgacccggcgctgttaaaggacgccgacttaattgtcgacgccatcttcgggatcgggattgaccggccggtcgagggcgcctacgccaccgtaattaagcaggttaacgccgcccacgccccggtggtcgccgttgacgttccctccggcatcaacaccgacaccggcgcggtgatgggcgtcgccgtcaaggcggacctgaccgttacctttgcctacaacaaaaccgggttggtgaccgaccagggccaggcctacgccggtcgggtcatcgtggcagatgacatggggacgtattaaagaagtgcggaccaaccttctcgacagaccgtatgactaagctaaagggaaggctgatgcgccccgcatcgttcttcacccgtacttaggcctgtggttggggagcacgttatctgtgttgcagtcaaaaaataaaaaggagttaggggaaaacacggttttctcctaactccttttttactatgcgcgggacttgtaagcaccgtcagacgtgttgacgatgatcttgtcgccgttcttaacgaaggatggcaccgttacgaccaggccagtgttcatcgtagctggcttaccaccaccgtcaatcgtggcccccttgatttccggttgggtttccacgacttctaaggtcaccgtagctggcaattcaatcccgaccagttcgctgtcaacgaagttcatttgtacttgcatgttttccgtcaggtacttcttttcttcgctgatttgggattggtcgatttcgtattgttcgtaagtttccaggtccatgaagacggacgtgttaccttcgtcgtaaaggtattgagcgttcttcttgttaaccatcacttgttccaccttttcagatgggcgcatcgtggtgtgcacaattgagccagaacgaacgtcttggatgtccatttgcatcagggtgttacccttacctggcttgtggtggttgatggcgagcaccttgagcagcttgccgtccttttcaaagaccatacccttcttcaagtcaatcgtttgaatcattgtcttactcctttacctaatagctagattatagtggcgccgcccttgattaaagccggcgaccaacttcgctttgccaccgggcgggcccgaacttggcatactttttcattatagcatgcttccctacttcttggcggggattcttattcgccgtttttggcctgttcaatcaggttggcggccgggacccgaatcagggtgtgctcatcggcctccttgttggcccgtagccccagcccgttgatcaagttgttcttgtagcgcaccgtgatcttggcggcaaaggcgcggctcgttgcttggtcttctttgcgcagtttgctttcgttccacgggtaggtcaccgccgcgctagataaaatgtcgttactatcggcgattgatgcgttcatcgccccgaccgtcacctttttggtcgtcgtccagtaagtataggaaacaacgtggtggtcaccgctaccgctgtggttagcccggacgtagtagtagtcattggtgttatcgttggtcagttgcaacgggtcgtatgaataactcaccgttacttgatcagaggttaaggctaccttacgaaacgccgtgaagtaaagcatcgtccccagccaggctaaggccaccaccaacaggaccacgtactttaaaaagagccccttttcaaaacgatgccccgtctttgcgattagcatcaactggtgcacccgaatatagtggatcacaaagcccaagaacactagggctaacaaccacagcaaccatcctagccaattccaactcatcttgtttactccttattatttccattacgtttttaaataaattgtaccacaacccggtacgcccctcggctttgttcaccaagtcggggcaagatttcacataaatttttcgcatctgtcccccaaaacccgtataatggataggaatatgctgatcaaatctgaaggagggcccctgatggctgaaaaatttaacgacctcgccgttgacatcatcaacttcgagcgtgaacaccaaatgattgataacgaaatcgcctacggcagccaattgaccgttgaacgaatccacgatatcaagtcacaagcaagcgtcgcaagcgaagaagaagaaagcttgatccgccgcttcatgcaatcacaaggttaatagttagcaacgtaaaaagggctgagaggttttctctcagccctttttacgttggtcgccggaagcggaccggcactggtgcgggggattcgatcacctgatcggggtgggcgatttgctctagcagggttgcaattagcttgtcggcaagctcttgaaccgggagcaccacggtggctaactccgggtttaagcgttgtatcaaccgggatccgttgtagccggtcacccaaaagtcttcattaattttacgtccgctggcccgtgccatcccctgcaactgaacggccacctcgtcgttaggggcgattaagccgttatattggtttaagggtagcggttttctgatcagttcgtccaactcgatcaccgcaagggcgttacctcgtctagctaacccatccacgatcccgtcaatccgacaccgggatgacatcggtgagtgagcttcgtccaaaactagggccacctctttggccccttgctccctcaggtaggcggccgccatccgccccccgctgtaagaatccaccgtcaccaccgggatcccctcggctagttggtgggcaaaggaaacgatcggtaccgccaaacgttggtagtgttcgttatccaagttatgggaactagagatgataccgtcgacttggttggctaacaagaccccgaggtgctcttgttctagttggtcgtcggtggcggtggtggcgatgataaccttgtagcccttggtaaagagccgttcttctaggcagttggtcaactcagctaaaaaggggttcgtgacgtttggcaacaccaggccaatgaaatgtgatgactttccctgcatcgcccgggccagggcattgggttggtaatcaagttctcgcatggccaaccaaaccttacgaatggttttgtcacttagcgagtggtagttattgatgacccgcgagaccgttgtcaccgatacccccgcccgcttggcaacgtcctttagtgttgaagtcatgttagctcacccgtttcgtaatcaatttcacgattataacgcaagtaagcgatttttaaaaaccttggacgccgttttggggcgacaaaaaaattactaacgctccgtggtctctttgaattgctcttgattaatcgcccacaaccaccctaatccgttctcaggacggggaccacttcacttatttgccaatctaagaaaagcggttacatgatgattgtgatcacgctatcaatcagagtgtgtgaaattaaaattaattaatttctactactaattaaataccataaatttcattgacctacccccgaaatcatgctagtttaaacgtgtattgaatacttaaaaaagtcttatcatttcgccattttagggaaaatgaaatacttatcatactcaaagaagataaatctaaaggagatccggcatatgcacaaaaagcaatcaaatgaccaatacctccactacaaaatgtacaaaagcggtcgcaagtgggtgtttgctggggtcgcagctctgaccttgctaacaacgactgaagtggctcacgctgacaccacgtcttcttcagctgcctccacggtcagcctcaacggttcaaccgttgccagtgaagcggctaaggcaaccgttacttttatttcagaaagtaccagcgccactagttctagctcaagcacggctagctcttctagctctgctacctccgctagttctagttccgtggccacggcagctactagcgtaaccagtgccaccagcgctactagcgcctcttcggtatcgtcaacgagcgctgacagctccgccagtgccgctacgtctagcgatgacgccagctcctcggccagcgcggcggatgccaacagtggcgtttcctccgctagtgccgccaccagtgctacgtcagcaagctctaccactgtggtccgggcggtggttgccgtggccactagcgctagtgcaagttcttcgtccgttgacctgtcaacgttaaccttctccaacaacgcctcccaacaggccttcatcgaaagcgtggctaaaggggcgatcgaaggttggaacgaatacggcgtcttgccgtcgatcaccgttgcccaggccattctcgaatccggttggggttcatccaccctttccacgcaagcccacaacctcttcgggattaaggggagctacaacggtaactacgtcacgatgagcacccgcgaagtgattaacgggcaaagcgtctacgttaacgccgccttccgggcttacgctaacaactccgaatccgttgaagaccacgggaacttcctctactccaactcccgttacagcaacctcttaggtgacactagttacaccgacgtcgcccaaaagctttcccaagacggttacgctaccgacccttactactcttcctctttgatcagcttagttaagacctacgacctgacccaattggacagcatcgccattgcgaacacgccggtgatcaccaacaagagcgattacacccaaaccaacaacggggcatccaccacggcgacggcaacttactacaccgtccaatccggcgacaccctgtccggaatcgccgttgaatacaacacgaccaccgcgacgttaacgagtttaaacaacttatccaacccgaacttgatctacgttgggcaacggctcctggtcaagagcgcatcgacttcagcggcgtcatccgcaacttcaacggccaccagcaccgctagcgcaactagtactagctccaccactagtgccactacctacacggtcaagtctggtgacaccctcagctcgattgctagctcccacaacacgaccacggcggcgttgacgagcttaaacagcctggccaacccgaacctgatttacgtgggccaagtccttaagttggctaacaccacgacggcaagcacgagttccaccagcagtgccgcttcaactagctcaagcgcaatgacttacacggttaagtccggtgataccctgagttcgatcgccagttcctacaacacgaccacctcgacgttgacgagtttgaacaacttatccaacccgaacttgatctacgtgggccaagtcctcaaggtagccggctcctctaccagtgtttctaccagcactagttctagttcggctagccaagcaacgaccagtggtacctacacggttaaagccggcgataccctcagttcgatcgctagctcctacaacacgactacggcggcgttagctagtgccaacagcatttccaacgccaacttgatctacgtaggccaagtcctcaaggtcactggcacttcttcaagcaccagcaccaccactagttccacttcctcaaccagtggttcttacaccgttaagtccggcgactcgctttccgccattgccgccgctcacggcttaaactggaagacgttagccgccaagaacaacatcgctagcccatacgtgatctacgttggtcaacagttatcgctttaaaattaatttaattatcaacaaaggacccgccaagcatggcgggtcctttgttcgttttggtccccatttttgaaatttaaccctaaaccgcttataatcaaaggcagatttaattccaatgagaggggccgtttttatggtaacaaacgaggctaataccaccattgatgcactagatcaggttagccacctgtttaaactgatggggcatcccaagcgcctccaactgctgtacctattgattcaacaatcgatgaccgtatcccaaattagcgaacgcttaaagtgggaacaatcggccgtctcccaccaactccaagtgttgcgtaagtaccagatcgtggagcgggttaaaaatgggcgccaggttgtttaccgcctggtcgaccccctcgtgatggggatcatcgccgacgtcgtgaatgaaatccgtaaataaaagtgggtaatcaccttctcggcaggtcgtatggctaagctagagcgcaccgttcttcgacttgcttaggcactagccctgcggttattttccacctttgctatctaaccttcgtgaatacagaaaaagaccgactgggtattccagccggccttttttcgttcttttaaaccccagtgacctagtgtccttggttatcggccaaaagttgaccaatcttttgagcgccctgtgcgtcgggggagataattaagagggtatcgttaccagcaatcgtccccactacctctggcatcgacaattcatcaaacatcccgccgaggatggtcgcgtaactcgagtccggggtggttttaacgacgttaacaaactcaacggtggtgtaagagaccacccggttggcaattgcccggtagagccggtcgtcatcctccttggcggccgccacctgagcataataggattgcccatcactgctgctaaccttagcaatgtttagggaatgaatatcccgtgaaacggttgcctgagtggcgacgaccccgtgttgcttcagcaattccaaaagctcctcttgggtagcaatgtgattttcttcgaccagttgttgaattaattggcggcgctgcttgtagttcatacccgatccctccactcgttgaatattcatttatccccttaatattaacccattcacctggggatacacaaattattttttaaataaatgacggtttggcggtctttaaaccggtttcataaaatatttacatttcacaagtagggagggaagtgcatattttacgccggtgttcctagcggtcgttcttcttttgccatttgcccatcaacgatcgtgtacacctggtcggcgaattcacgcagccgtaggtcatgggtgaccaccaccacggccttgttgtgcttgacggcgaggtcggaaaagagttggcccaccaccttaacccggtcggagtcgagggcggccgttggctcatcggctaagataatttgcgggtcagtgtaaagggcccgggcgatggccacccgctggttttgccccccggacagttcgcccgggtacttgtggatcagtttttcgatcccaaggtcttttaacaggtcccctaattcccccttggaaaggttaccgtggcgcatccggtcaaccagggcgaactgatccctcaccgttaagtaagggagcaggttgtaagactggagaacgaagccgatcttatccaggcgtaaccgatcgcgttgcttaccagacagggctgagatctcttggccgtcaatcaaaacttgtccctcagatggctgctggaggccaccggcgatcgttaagaaggtggacttccccgagccggacgggccaatcaccaggttaagcttgcccagttcagccttaaagttcacgtcagacaaaacgtgaacccgggcaatcccttgtccgtagtacttttcaacgttacgtaattcgattgcagtcataacgcttcctccttagttcagggcatctagcgggtcaatctttttaatcacccggacgggcaagagggccccaatgacccccatcaccaccagggccaccgctactccaatcgttagcggccagttaaaaagtattggcaccgcggttggtagtaccgccccggtcaccaccgttaataacaaggcaatgatcaccccgaccaccatcaggatcaaggcctgccccaaggtggcgttaatcaggcgttgggctgggattccctgtgcccgtaaaaccgcgtagttggccaatttttgcatcgtcaggatgtataagaagacggcgatgataatcacggaaatcaccatcaaaaagccgatcatgaactcaaagaccgtgttttgagcggaatagcccggcaacttctcaatgaaggtgttgaccgagtaggacgctagacccgccgtcactgccggcttggcttggtcactaatgattccggaagcgacaaactggttaccgaccccgcgcaggctttgccagacgctgaggtccccataggcaatggaagaaatgtttagtttggcatccttagcaaatccgaccaccgtgtactcggtcgctgaattaccaaatttcaccttggacccgagccggtagcccttatccttcaaggattcgtctaaaaccagctggttggacctctgtacccggtgaccactggtaattgctaacttatccttggcgataaactggtcttctttgagccccacgaactgcagggaggtcttgtggctctctttttgaccgaccgtttccatcaccactgggactaagccgagctcggcttcgtgcttggttaacttaggcagttggcttggtgcgatcagggactggctaaggctaacgttggcgtttttattcaaaacgaccgccttggttccccacgattcaatggcgaccgtgttctcactagccaagccaaacatcatccccatcaacaaaaacatcaggtagctagttaagaccaccatcgtcacgatgaggccgtagcgcaccttctcgtgaagaatctctttgattgctagaaacatcttcggtttccccctcttttaaaaggacccgcaagacacgttccaaccgtttcaaaatcaaatcttcgttttccggatccacgaggcactccttgatgctttcgtgaattagcatcatggctgaccaccgttgatcatccatcattgccttaaccttggccggtaagggatcgggtagcaacccctcgttggtcgtgtagtgcaaaacaaagaagttacgcaggctgccagacgtgtcagcgaggtcgcgcacccgttggatgtattccgtagccgtctgtaggtgacggcgcttcatatcatcccggctccccagcttggcagccagcaggtggtacatgtaggaataggcgtccgtgagattgtcaaagtacttgtaaaaggccccccgggcaatctgggcatccttaacgatgcgggccacttgggccgttgccagggtgtggttgctgaactcgtttaacagggcggcttcaatccgttgccgtttttcatctggaagattagtaaaggttgaacttggcatcttttcgtccacttctttctcatagtgacaccgtgtcactcgattaaggccattctaatcgcgaggtgacaccgtgtcaacttttttaataaaaataagagggtcccgttacggaactctcctaattctactatagatttgcgttaatgccagaggttaggcttcttcgccaccaaccttaacgatcgccttggaaaccttgcctaacttaccggaaacaaagtcttccacctgggtgaattccagttcgtgggagaacagcggcagtgggtccaccttgccactggccaagagggcaattgagtcttcaaaggtgtacgggttgatgaaggccccttgaatggtcaattgcttttggaagacgtcgtaagtgttaacggagaacttgtcgtccgggttcccgaccccaaacatcaggacttgggcgccccgggccgcagtagccaatgcttgttcttgggtcgccggggtcccaacggcttccacgacgatgtcaaaggcggcttctggcagttcttctttagtcgtgttgatcgtcttgacgccaaagtgttcgcggttgttggccaatttttcttcggagcggccggccaggataacttcgtgaatcccccgagcctttaaaatttgggcgaagagttgtccttcaaacccgtcccctaacacgagggccttttggtacgggtgggtggtcaaaaggtcaaccccgtgcatggcacaagagattggttccacaacggccgccgccttcaaggaaacattggctggcactgggtaaaccaccttggccggcgccgtgaagtattcttcaaagcccccatcacgggtcaccccaacggcgtctaggtgttcacacaattctgggcgttgggtccgacagtacttgcactgcccacagtagatgttcgggtccaccgttacccggtcgccaaccttaacgttagtgacgtttgcgccaaccttggcaacgaccccggagttttcgtgacctaaaacaatgggtggaacggcggaagcagaacccggcaaccctgcgtaaagggccttgtcggtcccacaaattccggcgaacgcggtgtgaactaaaacttcgtctggtttgatttcgggaatctcgtagtcttggactgccagatccttaatcccttgtaataccaatgccttcatcgtaaaatccttctctcttgtgaatttaataactttatggtgattagtatattcaaccatttagccaaagtcaaccggttgacatatgtttttttgtgaaattatttccttacccccaccaaccagaaaagaggtttgaaagcggctccttttagcacccgctaaatcccgtcattacgccaatcttacgttgcgcaaatcacttttttatgctaacctaacaaaggtgttccgggaagttaattagaaagctcgctgaacatttaaaaccataatcatgaggggaggatttggcgtggataacacaaagaatcaacaccgtaagctgcgcttaattgaacacgcaaacggtaaatcactagaagaaattaacgggacggttgaggtcccacatggcaagggcttttttaggaccctgttcgcctactccggtcccggggcactcgttgccgtggggtacatggatcccggtaactggtcaacttcgatcaccgggggccaatcgtttcaatacaccttaatgacgaccatcctgatctcaagtttgattgcgatgttgttacagtacatggctgccaaacttgggatcgtaagccagatggacctcgcgcaggccatccgcgcccgtacagggaaggcccttggggtgattttgtggttaatgaccgagttagccatcatggcgactgacattgccgaagttatcggggcggcgatcgccctgaacttgctcttccacattccgttagtcttagcggtcttcatcaccgtcttagacgtcttggtgctcttgttattgaccaagatcggtttccggaagatcgaagcgatcgtggcctgcttgatcctcgtgatcttagcggtcttcgcctaccaagttgccctgtcccaccccgactgggccggcgtcttcaagggcttgctcccgactaaagaagcgatcgccaaggaaccagtggtgggcggaatttccccgctgaccggttcgctggggattatcggggcgaccgtgatgccccacaacctgtacctacactccgccatttcccaaacgcgtaagattgaccacactaacgctgaagacatcaagcaaacggttcgcttcaccgcttgggactctaacattcaattaaccctggccttcttcgtcaacgccctcctgttgatcatgggggtagccgtcttcaagaacggtgccgtccaagattcttccttcttcggcttgtacgatgccttaaacaacactgacatgttaagcaacggcctcttgatcgccgtggccaagtccggggtcttatcaactttatttgccatcgccctgttggcttccgggcaaaactccaccattaccgggaccctgactggtcaggtcatcatggaagggtttgtccacatgaagatgccactgtgggcccggcgcctgatcacccggcttttatcggtggttcctgtcttggtctgcgtggcaatgacggcgcacgaatcaaccattgatcagcacgcctcgttaaacatactgatggaaaactcccaggtcttcttggccttcgcccttccattctcgatgctgccactgttaatcatgactaacagcgacaccgaaatgggccagttcaagaactcgctgtgggtccgggtcctcggctggatttcggtcatcggtttaaccttcttaaacctctacaacctaccgcaaacctatgaaggctttggcatttggtccaaggggctatccgacgtcttagcttggatctcaatcgtggtcatcgtggttctgttagcttggacttgtttcgaattaatccggggtgaccggcgcctagcggccgaacacgaaaagcacacctgggaaaaataagggaagtgcgatccaaccattggacttagccactaggccggcgacgttatcttaacaatcaacaataagggagtagcaaatagcccgttaggtaggttatttgctactcccttgatctttcttaattacttttaatctttccttacccgcccttcacacctttttcattacccggcggtatattataaccatcctcaattgatttttcttcttcgtcaacgaagcctgtctcctcccaatcgtttcggcttcgctgacacccaaagcccacgggaattcttttccgcgggctttccttttgtaatccgcctttcgtgttataatacgaaaagatccatcacgtgtgctaaattattagccctaaataatgagaggtgacgactttgaataacaatcacgacgatgaacaacagcatttatcgcgcgtcgaactctacgataccccaaagagtcatcgcacgaattcaaaacgccgtaagccccgccgccggggaccgaagaagccgggctttttcgctagtctctttgggggcccacggcggccgaaacggccaaatcgccgcccggtagccccaatggccaccgccgccaaccgcaaggggcctaaccgacggcctaaaaagcccgttagcaagcaaaagaaactcttccgcttggcgttgggcatcttgctggccatcctggtggtcatgatcgccgttttcgtggtcaagcaacaaaacccggttaacaccagctccgacgaaatctcgacttcttcaagctctaagtccagttcacacaagaagaagagtagcagcaagaagtcctcgagttcttcttctaccgactaccaggaaacctacacctactcatactctgaaccggaatcgagttcttcttccgtgtactcctccagttcctctgcttctagcagtaacgataaccagtcgacttacaccaacaccactaacactaatacctacaggtacggtaacaatggcggaacgggaactggtagtaatggcagtaccggtgatagcaatggttctgatagtggcaatagtggcagcactgataaaaatggctctaacactaccacccaaaacggaacccaaggtagcacggcaaaccaataaaactaagccacgccttgacatgccccttgagcatgctataatcgtttcaaatgcgggatacgcctaactacaagcggtaaaccagggaagggtgccatggctggaagcacctttacacggagtagttaaggtaccaccccatttcttgccccccgaaataagggggaccgggtcgtgcccgttaccacaccatagagaggattttaaatcctgaagatgggtggaaccacgctgaagttgttattttcaacgtccctaacgttgccaaagtgggtagcgttaggggcgtttttttattccaaaggaggagtttacatgccacaagttgccatcatgttaccaaacgggaccgttgaaaaggtcgaccgtgaatcaaaggaaagtttagacgccctgcgccaagtcgccgccctcttactcaaggctgccttgcaagaccaattcaagggaatccgcctcggggaagccgttgccgaagaagaccaattcttcgttgactccgataaggacaaccaacaagtctccgctgacgaattggaaggcttggaaagagccgttaagaagttagccaaggaaaaccccaagatcgaactggtcaaggtcagcgttgacgacgccgttaaggccgttgaaggtgaccaattctccagcgaactacttaaggaaaacgccgaagacggtcaagtatccctctacaagatgggcgacgcaacgatcttagcccaggcacccatcatgctgtacgctaacctcgttaagaacgttaagctcctctccgtggccggggcttactggaaggggatgtcctctaacccaatgctccaacggatttacgggaccgtcttcttcaagaaggaagacctggaagccgacttgaaggcccgccaagaagcccgcgaacgtgaccaccgggtgatcgggaaccaactcgacttgttcttcgttgatccaaaggtcggtgccgggttgccgtactggatgccaaaggggtccacgattcgccggacgatcgaacgttacgtgatcgacaaggaagttggcgatggctacgaacacgtctacacccctgtcttgatgaacctcgacgcctacaagacgtccggtcactgggaccactaccgcgaagacatgttcccgccaatggacatgggtgacggcgaactgctcgaactgcggccaatgaactgcccatcccacatccagatctacaagcaccacatccggtcttaccgtgaactgccactgcggatcgccgaactcgggatgatgcaccgttacgaaaagtccggggccctctccggtttgcaacgggtccgggaaatgaccttaaacgacggtcacaccttcgtggccctagaccaaatccaagacgaattcgccaagatcttgaagctgatcatggacgtctacaaggacttcaacatcaacgactacaccttccgcttatcctaccgtgacccgaagaacaccgaaaagtacttcgctaacgatgaaatgtgggaacgcagtcaatccatgttaaaggccgccatggattccatgggactggactactacgaagccgaaggggaagcggccttctacggaccaaagctggacatccaaaccaagaccgccctgggcaacgacgaaacgatgtccaccatccaactggacttcatgctgcctgaaaagtttgacctccactacgttggtgaagacggtaagcaacaccgcccagtcatgatccaccgtggggtggtcggcaccatggaacgcttcgtggcctacctgaccgaaatctacaagggagccttcccaacctggttggcaccaaaccaagtcaacatcatcccggtttccgatgaaaagcacggtgattacgctgatgacctggcccgtgaattccgggcagcccaactgcggaccgtcgttgaccaccgcagcgaaaagatgggttataagattcgcgaaagccagacccaaaaggttccgtacaccctggtagttggggaagacgaagtggctaacggcaccgtttccgtccgcaagtacggggaaaaggatcaagtaagcatgtccaagcaagacttcttggacctgatcttacacgacgttgctacttactcacgcgaagactaattattaagcgaggaaactctaataggacggactaggcgtcagccgccgtttattatccacgctaaatccatatacaaagaggctatggcaagtttgccacagcctctttgtcgtctttaacacttttatcgggagaaaaatcaattgaagatcattatcgtaactctttgtctattaaccatcggcaccctgctttggtccctcaagcaaggcaaccatgctaagcgtccattttggtggcgcctaaccctgatcattgccactttgaccctctttaccgccgccattggtaccaccactaacgttgacgccgcgcaaaggccgacggtgattattaaaaaactcggccactcctccatggttaaggaaagcaaggcccacgacagcctgttggttaaacgcgattccttgagcgccaagctagccagcctcaaggaacaattgagcgccgctgagtctagcagtgaggaagctagttctaaagaggcagcggctagcgctcaggcagccagtgctagccaagccagcgctaacgctactgacgccgatacgcaaccaagttacggcgccgctacgtcaacgaccactgcgggaaccgtcgccaccgggaacggctccaatgtcatcgtcggcgatgcccgctccaagaagtaccacttgccgacccaagctacttaccacatcaaggccggcaacaccgtttacttcagcaccgagcaagaagcgattaacgctggttacacgaagtcaggacggtaagcaagatgaaaaacttccaccacaaagcgaccatctccgtcctcggctttgccgcactgttcttaatgaccgtgggcctagtcacccactctggcactaaggaatcggcggtcgtggccagtcccgcttccagcagttacagttacgaccgtaccgaccaacggcgggccgcttcttttagcaaggaaaaccaggtcctccaaaaaaagatcacccacctgcaaaagcagattaaagaaaccaaggaagaacttagcgactacggcgtccaaccggcaacccccagcaagcaatccagccaagccggcactaatttagccaacctggactataccggccaagacgtcatcaccgttgacaataatcaaccaagcttctcggaagccgacttgtcccttgcaaacggcgcttggcaaagctacgggaacttggaccagtataaccgtcccggggcggccaatgcgatgctcaaccaatcgctgatgcccaccgtcaaacgggaagccctgaccgtcgacccgactggttggcataacaaacgcgtcaatggtcagtggctctacaaccgctcacacctaattggctaccagctaaccgggcaaaacaataacttcaaaaatctgattaccgggacccgccagttaaacgaccccgacatgctcaagtacgaagacgaagtggccgcttacctaaagcaatccccggaccactacgttcgctaccgggttaccccgatcttccggggcaacgaactcctcgcccgcggggtggaaatggaggcccaagcggtcggcagcgacgccgttaagttccacgtgtacatctttaacgtccaacccggcgtcaccttaaattacaacgacggtaccagtcaggtgaactaggtcgtttcatatgaaacaaagaatggaagtgctcaccaacctactcgacaggccgttggcataggttaacgcgacagcggcgttctgtggccagacttagccactaggcctgtggttgggaagcacgttctctgagtaaccaccgaagagtcaaccaccactgactaaagtcagtggcttgtgagccgaatatcatcacggatttcgaaccacaatttgcgtagatagggacaacttatttgaccaactgaaattgtaatcaaacagcggtcgtctaattaccaacgccttttatgtccccaggttgccatagggacagataagctaggctagtttagctattcccttatcaagaatgtttttagctgcgttccagtcacgaatatgatgaataccacagttaggacaagtccagtttctatcatctaatgttagtttgtccgtcccattagtgcccattacaaagccacaatcgcgacatgtttgggtagtatttcttgggttgattgtgataaattgacgcccataaagctttgctttataagccaacatgccaagaaatgttcgccagccaacgtcagaaatactaagtgctaaagcatgatttttaagcaaattcttgctacgcaactcctcggctactactaaatcgtggttcttgattaatgcggtagaaatttgttggagaaaattatgcctttggttcattaccttggcatggagtttagcgactaacaagcgctgtttttgataatttttactatctcgtaaagaacgatgttctttttttgcacgttgttgccgtctagataaaatgcgctgttctttggctaatttacctttaatagtgcggtaatatcgtggattaggaactatgttgccttcactgtcggttaagaagttatcagtattaagatcaattccaacatgtccatgagtagctttggacactttaacaaaagattcatctgaagctaactgcattgataaaaagaagcgatccgctgaatctttagtcaacgtcacggtaccaattctagtctcgcatattcttttcaaaagccgtgcttgcgaaccggcaacacgtaacagtcctattttaggtactttgacatgactattatctagaaaacagactgtaccgttagttagcaacgcagttttttgccccgggtattgacaattggtttgataccgccagtaataactctttcgatgaaatttgggaacgccagtggcgtgaaccttccgaaaagcattccaagcttttcgatagttctgaatggcattagctttcgtcaaactatcaattcgtttatcttctaagaattgatagtgattagacatttgcttagcgttttggcgcatagttagttgcttaatacgatcctgaactatgtcaatcggtagcttaactctgcgaagctgcatcagttccttattgatcgcaaccatttcgttatagataaagcgactagcggcactgttgattttaatcaactgcttttgttggtcactaggatagcagcgcatttttaggccataatgatatttcatttttgccattgacttaatttgatttcacctcctttattgatatgataacattatatcatgatgtcaatgtattaacaaaggagagcatattatgactaaagaaaaaattaaagatgccatttatactcgtcgttatatctataatttccattatcatttgatctgggtaactaagtatcgcaatcagacttttacaaccgaggtcttatctaacgaaatgaaagctatcttgcagcaagttgcagatgacaatgacatcgtaatcgaaaagatggaagtcatgccggatcacattcatatgctgatcagttttccgccaagcaaagctccggctagtgccattaaggcgctcaaaggacgtagtgcctatatttttttacagaatcatccagaaatacgatgtagccaatattggggcggtcatctttggtcgccgagttactatatgagtacattgggcaatatgagcaaagaagttgtcgagaaatatatcaatgaccaaaaatatacagaaacaaacaaaaagccccataaaggggctcaatagtggcctatccatcccatgactaaagtcacgggatttccagctaatattaattaaaaaggcgacgatgaccgaattagtcatcgtcgcctttttagctaattccccgtaaagtaatgcttccagagctggttaacgttgtacttatgctgcttggtgctcgaggaccaaaagcccaccttgacgaccccgacaatcttattcttcggcacaaagccccagtaacgactgtcgttagagaccgaacggtggtcccccaaaacaaagtacattccctttgggaccttggtggcgcccatattcttcatccagttattctcttcggaaattgacgctaaagtccaattccccgtcccggtcgttcgttggtacttagagatgtaggattggttggtcttcttaccgttgacgtagatgtagccgttcttggcttccaccgtgtcacccggtaaggcgattacccgcttaacgtagtcggtcgtttgcgatacctgggggtcaaccccgttggcatcgaagacgatgacgctaccgcggtgaatcttcgatgttttaacggccaccacccgttcgttattttgtaggttgggttgcatcgatggcccgtccactttcacgagctggaaggcaaattgcttcactagcaacgcgatgatgagcccgatcgccactgggattagccagcttaaggtttgtcgtagtgctttcattttaaattttagccccgcttttttattgatcacccttatcttacaacaaaggtagcgtttctcctagtcagacgttacccctccagatgggcgatcacttggcgggcaacggcgatgtcgccagggtagggggtatccacccctgccaccttttggtactggtcggtccccttaccggcgaggacaactaggtcccccgcccgggcggcttggattgccgtttcaatcgcttccctgcgatcggccacgtattcgacttggccaacccgatcgtgatcgatgtgggcgtcaatttccgcggcgatcgcctgggggtcttcaaaggcgggatcatcggtcgtcaaaattacccggttgacccgctcttcagctagggccttaccgaggtccggccgccgtgaaacccccttgttaccaggcgcccctaagaccaccgtaatctggctcagctctccttggtgttgctggccctttaaaaaggctaagagacgcttaacggaggcgtagtcgtgggcgtaatcaacgtagaccgtgccgtgctcttgggtcctaatcacttccatccggccggcgatgtggacctgcccaaaggcctcctggatggttttctttttgaccccaccaatggcggcacaaatagcggcggccgtggcgttacccacgttgtaatcgccagccacgctggactggtactccccgtctaacatcagggcgctcccgcggtcactcaccccggttaactggaagttagaaccagccaagccggttgactggatttggtaagccaggtctaagtcagggtgactgccggcttccccgaacaggtaaatcttgtccggggccgtcgagaccttggcggcctggtaaacctcttcgaaatggtccatctgggtgtttagcacgcaaacgctggaatttaagagcagctgctccttgcaaaagaggtagttggcaaagtcggggtgctcgttttgaccaacgtggtcgctggaaatattcaaaaagaccccgatcccgaagtgtagggagtagacccggtcgagcaagtaggattgcgaagagacttccatcactaggtgggtcatcccattatcgacggcttggcgtagatagcgaaagaggtctaacgattcaggggtggtcaacttggacttgaagacgtcacccttgcccaacgaagtatttaaagttgagatcaaggcggtccggtcgtcggtccccaggttcagggccgtggcggcgaagtaggccgtcgatgttttccccttggtcccggtgatcccaatcgcaaagaggtcgttggacgggaaaccgtaaaaggcgttggatagcagcgccatcgcccgttggatgttggtgacgatcagggccgtcgccccgttttggtagctttgttcggccacgtaagccgttgccccgcggtcaatcgcctcgtttaagtaatcctctttaaaggccgcacccttacaaaagaagagggtttcggactgaacgagcttggaattgtactcaacgtggtagaagaagtgctggcggtagttttccgtccgcaccaagaggccgtgttcggtcagcaaagaaatggccgagttagtatcaatgtgaacttggtcgattatttgcagggtcatcgcattatttctccatcaattgcttagtaatctggtagtcgccttggtaaggaacgtccttacccttttcgtgcataaaggtttcccgtcccttggcggccataaagagggcgtcgccaggcttagccattgcgtaggcctgctcaattgccgccttacggtcaacgttgacgatgacctcgaggtcggggttatcaatgttttccttaatgtcagcggcgatctggtgagggtcttcaaagaagttatcctcagaggttaaaatcgccacatcggcgtactgggacagggcgcgcccaatgtctttacggcgggattcggccttgcccccagccgccccgatcaccacgatcaagcggccatctttaaattcgtgcttcatgaagttgaagctagccgtcaggctcaagtagttgtgggcgtaatcgacgcaggccaccacgccctgcttgtccttgataaattccatccgtcctggcacggtcgtttcggccaggcccgcccgaaagtcctcgctgaccggggccacttgggccgccacggtcaatgcggccagggcgtttgcgacgttaaagtcccccggcatcataactcgaaaatcgccgtcaagcttaggcagggccgggttagcggtggtaacggtgaagtaaccgtgttcacccagtcggtattggtaatcggccgccgattgatcgctcccaaatgaaattacctgcttgcccaggtcgtgtgccttttcggccaggtaatcgtactgactgcactcccggttaacgacgaggatcctgcagttgtcgatgatttcactcttgcaggccaggtagtcttcaaagctcgggtgttccaccggactaatatggtcgggcgagatgtttaaaaagacgccgatatcaaggggcaggccaaagacccgcgacttcttataggactgggaagaaacctccatcaccaagtacttcatctggttgtcgacggcctctttcatcatcctaaagaggtctaaggactccggcgtcgttaagtgggccgggatgaaggtttcgccgtccaaacactcgtcaatcgaggaaagctgggcgaccactttccccagggccttggccatgacgtggcgggtgaagtaaaccgaggtcgtcttccccttggtcccggtgtagccaatcacggtcagattgcggtccgggtagccaaagaaggcccgggacacggtcgccatcgccttttgaatatcggtaacgatcacttggggtaagtcagggtgctcactagtttttaactgggcggagtaatccgccggggccatcgccacgctcgccccctggttagcggccatcgtcaggtacttaggatcaaacttgaggcccttacaaaagaagagggtcccctccttgaccgtccgcgagtcgtaagacagatctaatacggtgcggttggccaactcctccggcgcccggtcgtgccacttgccggccacaatcaattccttgaacaaccctgcatcctttaagaccgtgataatttcgcttagcgtcattgtcattattgcattacctcagcatccgcttgcttcgtgtattccggcacgtagttatcgataaagtagagcttgtaccataccaagaaggtgtaaatcgtccacaacttacggcggccgtcgatcttttggtggtagttgtcatcggctaactgcaagatcttgtcctggtcgaagaattccttaacgaagtcctcttcaaatagggcccgtacttcttggtagtacttgtcttcgtggagccattcgcgaattggaaccgggaagcccatcttcggccgggtcgcccattcctctggcaggtgccggttagcggccatccggaaggcccacttggtccccttgtagttaaagaggtacttagttggcgtgtgggaagccacgttcatgacttccttatccaagagcggcacccgtaattctagggagttcgccatactcatcttgtcggccttgagcaagatgtcacctggcatccactggtgcaggtccacgtattggcgcttggccacttcatcgatatcctttggttcgatcttgtcaaagtacggggccaggatttcttggatcgttggtccgcaatcaaagtccttgttcaagacgtcgctcgcctcttctggcgagaagatgtaggcttgcccgacgaagtcttcgcgggccggggccatggcgtggtacatgtgcaaacgaccgtggaagttcttgtggttcttcagccattccccaatcttgtagcgggttggttgtggcaacttacgcatctggtcggttacccagcggatcggcttagaggaagtgttgaagccgtagtcggtgtagccggcaaagagttcgtcggccccttccccggataacatcgccttgtagccgttgtccttagccaacttggtcaagaagtacaacggcaccacggacgggttagaatccggttcgtccaggtagtactggatggtcggaaaggcgttgaaggcttcctcgttggtcagcttcttgtcggtgtttttcagcttcagcttttcggccagttcgcgggcctgcttggtttcgtcgtagcgggagtcaaacccgatcgagaaggtgttgtcagggcgcatcatcgccgttacgtaagaggagtccaccccagctgacaagaaggaaccaaccttgatcccggcatcggcaaaggagtgggccttaaccgattcgtcaacggccgcttcgatcttatcgacggcctggttgaagctttccttgtccggggagaagtcggcgtcccagtactgttccattgagaattcgccgttcttgtaacggaagaagtgaccctctggcaggcggtaaacgcccttaaagaaggtttcatcagtagcggggtactggaaggtcatgtacggctttaaggcttccttgttcaattgcttatcaaagttcgggtgatccaagaaggacttgatttcggaaccgacaaagaaggtcccgttcatcttggcgtaatacagcggcttgattccgaagtgatcgcgagccccaaacatttcgccggtctcccggttccaaataacgaagccgaacatcccgcgtagcttcttgacgacgccttcaccccactcttcgtaaccgtgcaggataacttcggtgtcggcatgagtactaaaggtgtgaccggccttaattaattcttctcgcaggggcttaaagttatagatttccccgttgaagatgaccgcctttgagtcgtcctcgttaaagatgggttggttccccgacttaacgtcgataaaggacaaccggcgaaaacctaatgccgcctgctcgtcaacaaacattccggaatcatccggtccccggtggataatccggttcatcatcttttgaatttgaacttccttttgttgtggcttctcattatccacgaacgcaacaattccacacattgttttcaactccaattctcgttttgtctgggtcatttcccgggaaatatctctccccaatggacccgcaaagcgccgtaaaatctatataatgatagtctttttccccgttcatgtaaaccgattgaacccttaaggatttctaatgttccacctgtctttttatgaatatctggtgaatattacggtatttgttttattttatgttagaatggattgatcaattgtgaaattttatccatttagaaagaagggcttcttttgaaatcttcagccgacgctgccgccggtaccgaaaatcacgaaatgcggcggagcttaaagacccgccacttatcgatgattgccttgggtggttccatcgggaccgggttcttaatcgcttccggttcggcaattgctaccgccggtcccgggggcgccttagtcgtttacgccctaatggggatcatggtttactttctgatgacctctttaggggaaatggcgaccttctcgccgactaccggctcctttgttacctactctgccgattacgtcgacccggcctttggctttgcgatggggtggaactactggtttaactggaccatcacgatcactgttgacgccgtttcctgcggggtggtcatgaacttctggttcccccacctaccgtcatggattttttcgtccgtcgtctttgtcctaatcgccctgatcaactggctgtcggtcaaatcttacggggagaccgaatattggctctcctttatcaaggtggttacgatcggcttcttcttggtggtcggctttttggttatcttcgggatcatggggggccactccgccatcggcttaaagaactttacttacaaacaagcaccgtttgttggtggcttcccgtcaatgtttgccgtcttcttggtggccgggatgtcctttcagggaaccgagctggtcggaattacggccggagagtcggctgaccccagacacgccgttcctaaggcgattcactcgaccttctggcggatcctcttgttctacttactgtcgatctttgtgatggcttgcatcctgccgtacaccgacaagaacctcctgtcgtctagcgtcaaggacgtttccatgagcccgctaacgatcgtctttgaacgggccggactagctgccgcggcctcagtcatgaacgccgtaatctttaccgccctgttgtcggctgccaactccggtttgtacgcttcaacccgaatgctttacacccaagccaaggaaggctttgcctggaagatctttggctacgtcaacaagcgcgggattccgatctatgccatggtcgggacgatggtgatctccctagccgtgttcgccacccagttcttgggcaaggatgcctacaactacctaattaacgcctccgggctctccggctttatcgcctggctcgggatcgccgtggcccactaccgcttccggcgtgcctacgtcaagcagggacgcaagctcagcgacctcaattacaaggccgccctcttcccgtttggccccatctttgcctttatcctctgcctaatcgccgttggggggcaaaacctgggggctttcgctaagcttgactgggaaaacatcctgattacctacatgtcagtgccgttgtttgtgattttatacatctactacaaggtcaagtacaagaccaagttgattccgctagcagaggtcaacttggaggcccaccgcaactagaacggagtggtagcccactattctatccctccaacaaataaaatccggttacttcgtcaaataacgaagtaaccggatttttactttacagcggcgttggttaccacttctttacttatcttgcttcttcagtaattcgacaatttggccaaggtattcttcttccttggacgggccctctttgaccgcttcttcttccttctttggcattaccttgttgatccccttgaccatcaagaagaccacgaaggctatgatcaagaagttgatcacttcgtttaagaaggaaccgtaacggaagtgggcggaaccgatggaaaagaccaggttggacaagtcgatcttccccaggaaaatcccgatcaacgggttaatcaaatcggaaaccaacgacttcacgattgccgtgaaggcagccccgatgataaccccaacggccaggtccatcacgttcccgcgggcgatgaactctttaaactcttttaacatacgcatcctcgctttctcaattagctaaggtggtgcgcaccaccttaagaatcttttaataaatattggccggaaatcccgtgactttagtcatgggatggataggcttctacttacgtcctttagggcgtttttttatttcattgtacttttgattattgatatattgctcaacgacctccttgctcatattccctaaagtactcatgtaatagctaggggaccagaggtggccaccccaatactgcgactggcggatttccgggtgtcgcttgaggaaaatgaaggcactgcgtcctttgagggctttgatagcgctagttggtgctttactaggtggaaaactaatcaacacatggacgtggtcaggcattacttccatgtgctcaatcacgatttcgttatctgccgcaaccgttgtaaggatttccttcatttcattcactaacgcttcactagtaaaagttggattacgatacttggttacccaaatcaaatggtagtgaaagttataaatataacgccgtgtataaatggcatcttcgattttgtccttcgacatgattgccacgctccttaattattattgtcattgacatatggtataataacactatatcagtgaaggaggtgaaaataaatgaagtcaatggcgcagatgaaatatcattacggactcaaggtgcggatttatccaagcgacaggcaaaagaaaattatcaagatcaatagtgatgctagtcgattcatctataacgaaatggtcgctattaacaaggaactttggcggctaaaacaggttaaactcccgattgataccattcagaaccggattgagcaactggagcttcgccaaagcgctaaacaaatgtctaatcatttccagttcttagaagataaaaggatcgatagcttgactaaagccaatgccattcaaaactaccataaagcttggaatgcttttcgcaaagttcataccgcaggtgtgcctaagtttcaccggaaaagttacgtctggcgttatcaaactaactgccagtatttgaaacagaaggcagcatacttaactaacggaactgtacattttgaagatagtaagcatgtgatagtgcctaaattagtcggctccgtgttaaaggttcccatcaacgagtcttagctcgcagtgctgaaacccgtattggaacggtaaccatcgtaaaggacgctagcggtcgtttctttctctcaatgcagttagcgtcggatactccctttgtcaattggccgcaaaatacaggcaagcagattgggattgatcttaatactgaaaacttcttaactactagtaatggcgatactgtggctaatccacgctattaccgcataattaagggtcgcttagccaaagcacagcgcatcttatcgcgacgggctcgtcgggccaaacaagaacatcgaccattacggactagtaagaactaccaaaagcaacgcttgttggtggctaaattacacgcccaagtctttgaacgtcgacgtgactttctccacaatgtctcgactacactaatcaagaaccacgatttcgtagccgcagaggaattgcggagtaaaaatatgctgaagaatcatgctttagcgatgagtattgcggacgtaggttggcggactttcttaggaatgttggcttataaagcagaactctaccatcgccaattccttacggtgaatcctaagaacactacgcaggcttgccatgaatgtggttttgtgatgggtacagtagggacagagaaactcacacttgcagaccgagaatggacatgcccaaagtgccatgctcaccacgttcgtgaccataacgctgcgcagaatattctaactaaaggaattattaaattagcctaatttggctcgtccctatggcaacctggggacgctaaaggcattggtaattgccgtgtaagacgaaacggttcgtagaactgttcgcagtggtgtatctatgcaaattgtgattcaaacactcatcagaagggtgcttgctcacaagccactgactttagtcagtggtggttgacctattcatcagggtgccagactagtaatttaaaatttaaaaccagaccatttgagcgaacacgtacttattaaacaatttgtgtttgttacttcaactttccctgccgcaggtacacggacaggatggccaggtcagccgggttaacaccggagatccgggaggcctgggcgagggtggtcgggcgaatctgctccaacttttggcgcccttccgtggctaagccttcaatagcttggtaatcaatatcggctggaatccgcttagcttccatccgcttgaggcgttcaatcttagcctcttctttttcgatgtagccggcgtacttaagttgaatctcaacctgttctacttcctggcggtccagttcaacggccggcgcatcaacaaatttcagaagggttgggtagtcgacgtacggccggcgtaagaaggcatcggcagcgatggcgtccttaagcggcttatcaccgtgggccaccacaaaggcgtcaatttcttcccccggtttgatccggaagtccttcaagcgggcgatttcgtcttccacccgttgcttcttttcttccatggccgccaggcgctcatcggacaccagcccgattgcatgtcccttttccatcaaacgaaggtcggcgttgtcgtggcgtaggatcaaccggtactcggcccggctagttagcaagcggtaaggttctttggttcccttggtgactaggtcgtcgatcatcaccccaatgtaggcgtcggagcgcttcaaaacaaacggttccttgccctgggcgcgcaggccggcgttaatcccggcgatcaggccttggccggccgcctcttcgtaccccgaggtcccgttggtctgcccagctgtgtaaagattgttaaccaacttggtttccagagtggcctttaattggtacggggctaccacgtcgtactcgatggcgtaacccggccgcatcagttcggcgtgctccaacccggccaccgagtggatcatctggtgctggatttcttctggcattgacgtcgacagcccgtccaagtaaaactcgtcggtgtcccgcccttccggttccaagaagacctggtggcggtccttgtcggcaaagcggacgatcttatcttcaattgacggacagtagcgtggtcccaccccttcgatcaccccagagaacattggggcgcggtcgaggttgttacgtaaaatttcgtgggtggtcgggttagtgtaggttagccaagaagaaatctggtctttgaccgggatgtaggaagtgtccggcgtgtcaaaggagaagtggtttggtgtttggtcacccggctgttcctcggtcttggagtaatcaatcgtgttcccgtccactcgtggcggcgtcccagtcttaaaccgctggaggtcaaagccgagccgctccagggcttcggacaacttaacggcggccttagagttattcgggccggattggtactggagttcgccgatgatgatcttaccccgggcggccgtcccgaccgtcaaaaccactgccttggcgtggtaagccgccccggtgttggtgatgacccccttgacggtgccgtcttctacgatcaggtcgtcaaccaccccttggcgtagggtcaggttcttttccttttcaatcgtccacttcatctggcggtggtaggcgtgcttatcggcttgtgcccgcaacgcccgcacggccgggcccttcccggtgttgagcatccgcatctggatgtaggtcttatcaatgttgtgacccatctcaccgccgagggcgtcgatttcgcggaccacgacccccttggccgggcccccgagtgacggattacatggcatgaaggcgaccatttccaggctgatcgtgatcaagagggtcttattccccatccgggcagcggctagggcggcttcggagccggcgtgccccgcccccacaacgattacgtcgtagtcgcccccgttgtagttaacaactttggtttccattctcgtttcttcctctactttcctaaacagaattggctaaagagctggtcaagcaactcgtcttggtaggtctggccggtaatttcccccagcgtgttccaagcgtcggtcatatcaatttgcaccaggtcaaccggcattccggcctcgatcccctccaaaacggcgttgagcgagtcaactgcctggtgcaacaggccgatgtggcgggcgttagtgaccatcacggcgccccgattagattcaatcccctcgttaaagaagcggtgggcgattgcttgacccagttcctgcatcccggcgtgttccaagatggaggtctgaatgactgggtcaccgttaacgagttcggttagctcagccaggtcaacttgagccggcaggtcggtcttgttaaagatcaccatccggggtttttgtgcggtggcctcaattagcgcccggtcctcttcggtcagcgggcggctggagtcgatcaacaagaggatcaggtcggcggtttcaatcgcttgcttggagcgctcaaccccgattttttcgaccgtgtcgtcagtgtgacggatccctgccgtgtcaattagcttcagtggtaccccagccacgttgacgtattcttcaatcacgtcacgggtcgtccccgctacttcggtcacgatcgccttatcctcgtgcaagagggcgtttaaaaggctcgacttgccgacgttcggtcgcccaatgatggcggtggccaggccgtcgcgtaagaccttgccttccttggccgtttgtaagagggtttccaagcgttggcgaacctcgctggccttttcctttagcatcttagtggtcatctcttcgaccgcgtcgtattcggggtagtcgatgttgacctctacctgggccaaaacgtccaggatatcttggcgtagggccttaatcaaccgcgacaggtctccgtcgagttggtttagggccaccttcatcgacttgtcagtcttggcccggatcagatccatcaccgcttcggcctgggagaggtctaaacggccgtttaaaaaggcccgcttggtgtactcaccgggttcggccaaccgcgccccgttggttaaggttaattgtagggcccggttagtcgccaacagccccccatggcagttgatttccaccacgtcttctttggtgtaggtcttgggggctaacatcaccgaaaccattacctcatctaccgtttccccgcttgcgggatcgatgatgtgcccgtagttaatggtgtggcttttaacttggtgaagatccttgcccttaaaaatccggctcaccacgtctagggcctggtcgccggacacccggatgattgagatccccccttccccaaccggggtcgagattgccgcaattgtgtcttgctctgaatttgccatctgttggtcctttctcgttcaaagaaaaaagtgcccctccacgaagccccggtttcccgcggtcatggtcaaagcactttcactactctaacgaagttttcaattttaacgtatttattgtaagaactttgcccgcccttgtcaattatttgggggcgatcacgaccgagcggaagggttcacgcccctgcgaataggtcttgacgttcggattatcctctagttgcttatgcaagagtttgcgttccctggccggcatcgggtccaaaaagaccgcttggccgctagcgatgacgtcggtgaccgcccgctccccaatccgggtaattgtttgcgcccgcttggcccggtagccttcgctgtctaaggtcacctgggcgtccttgaccccctggtagtttaaaaaggcgacactgagcacctcaaaggcgttgatccgccgcccgtggtagccaattaccctcccgggcgttggtgcgttcagctcaatcgtgacgtccttggccccgctactttgaaccgtggctgaaacgtcgacccctagtgcccggtaggcctgctccaggtagtcgaccaacttggtagcggcggccgacatccgatggaggttttgttcgtggcgggcggcaatttccgccgggcttaattgaccgtccggcgccccttctggattgccttctggctgctcagtggccactggttcttctataagttgaggcgtttgctcggcggggtcttcttgttgaaccggagccacctcttctggtgacgatgacagtgtgggcgttgctggttcaaccactttcttgaccaccgcctcaatcttaaccggccgggcgcccaggccaaacaggccccgccgaccagggtcgaccaccgtgatggttaattccgcttgcggcttgttcaggtcttgttgcgcctttaaaacggcgtcttggtacgtttttccttggtactcactcattgacttccccctcgaaaaaaaaggcagggaaaatttcattttctcccggcctcttattctatttctaaattacttgcgcttgctagagtaggcccgacgcttggctttttcaatcttgcgttgcttggccttttgtgccgcctgctttgcttcgcgttcccgccgaatcttgaacgggttttggatcactaaggtctgaaccacttggaaggcgttagtgaccacccagtagagggtgatggccgccgagaactggagggccataaagaagatcatgattggcattacccaggtcatcgtcgtggtcatcgagttcttttctggcatcgaggccattgacagccaagaagaaatgaaggtaaagaccgctgccagaatcggtaagacgaagtaggggtcggtgtgtcctaactggagccacaagaaggtccccgtctttaattgggccgtccgccaaatggcttggtacaaggcccacatgactggtaactgtatcaacagcggcagcatcgacgcaaacgggttgacgcccgcttccttgtagagcttttgttgctcaatttgtagctgctgcatcgtttcgcggtccttagacgagtactttttttgcagggccttcaattgcggcgccagctcctgggtcttcatcatggacttggtctggtaaaacatcattggcaagatgatgatccggatgatgatcgtaaagatgatgatccccatcccgtaaccaccaaagatgttggacagccaaataataaaccgcgaacagttgtaaacaatgtagtggtcccaaatcccggtactgtgactggtaatcggcttgttagaacatgccgccagcagcagggtgagccctaagatccccgtcagacttaagacctttttgccgtgttttttcaaaccttgatcctctctttacttttcctcaaacaggtgtgccaacgtaagtgcatggaccagattcttcttgatttccttcattgaaaggtcggccgccgatttacgggcgattaccaagaagtcaacgtcctgctttaattcgggcttaacctcgagcagggtttggcggatccgtcgtttgacccagccccgctggacggcgttgcccacctttttaccgaccgaaatcccgacccggaagtggggttggttcggtttttgcatctggtagatcacaaacttatgattggccactgaattatgagtttcaaacacacgttggaagtcgctttccttttttattcggtacgattttttcatttagtcagtctccaacccgttaaaccaaaaaagggccgggcaacgacaactacaacatcacgattgcagtatatgtggctgcccggcccctttatggttacttaacgtaacgatattatgcagataatgccttgcggcccttttgacgccgacgggctaataccttccggccgttgctagtgctcatccgagcgcggaagccgtgaacacgggcacggtggcgcttcttaggttgaaatgtgcgcttcattgttttgcacctccttagcagctgatttttttagtttctttattaaaacgtccgtttaaaaagagtcctctcttcaaacatacttttgaagtatagcatacttttgggagggaaggaaccgccaagtcggcgaaaaaaataaattccccttgacagttttccacaaataatccacagcgttgtgtatttctttttgcggcgtcgccttatccaagggcttttgacttatcccaccccggtgggtaaagttatccacaagccggtggataacttttgaaaacgcgttcagatcggcgtttggagcggtggatatccccactaagctgtggataaatagaattaagccccagtttttccacctttccacacccctggggataatttccacacaccgttgtttataactggctttaaatttttccacctgtggaaaactccggccaggaatgataaaatatcggttgtaaattttttctaatgcattcagacgtagaggaggaatcattttgactgagctcgattctctttgggaagcgatccaaaattcattccgtaagtctaagggcgatacgacttacaaaaacttaattgctccggcaaaacccctcgacttcgctaacggcaggcttcgcatccagctgccctcccagtaccaccgcgacttttgggagcagctgaccgaccaggtcgtcgaaatcgtctaccaacgcaccggccaagaaattcgcccggactacgtgttggcaaccgatccgacccccctggcccaaacgccgccccggccacagtcgacctttaaagaggaaacgcccctcaacccggagtacaccttccaaaccttcattgaaggacgtagcaacatgatggcctacgcttcagcctttgcggcttccgagtccccgggtgaccagtacaacccgctcctgatttacgggggcgtcggcctaggcaagacccacttgatgcaagccatcgctaacaacatgaagtttcacaaccccagcgtacggatcaagtacgtaaccagcgaaaacttcatgaacgacttcgttaactctattaaatccgggacccaagaggagttccgccgcgaataccgcgacctcgacgccctcttggtcgacgatattcagttcttcgcctccaagggggagacgcaaaccgaatttttcaatacctttaacgtcttatacgacaacaaaaagcagattgtcctgacctccgataaggatccccgcgaaatccccaacctgacggcacggttggtctcccgctttatgtggggggtcccggtcgaaattacctcgccggcactggaaacccggattgcgattttaaagtccaaggctgaagaagagcacctcgacgtgccaaacgacgtcttaaacttcgttgcccaacgcatcaacaccaacgtccgcgaattagaaggggccctgatgagaatccgggtcttttccgaactccaccagcaaccgattaccctcaaactggctaccgaggccctgcagggaatggttgccaacaccgaaacgacggtcaccattgacctaattcaaaagcgtgtcgccacctattacaacattaaccaatccgacattaccggcaaaaagcggaccaaaaacatcgtcgttccccgccagattgccatgtacctgtcccgggagttaaccgataattccctaccaaagatcggtaaagaattcggcggcaaggaccacaccaccgtactgcacgccatcgataagatcgaaaggcaggttcaagaagacgcccgcctgcagggggacttggttaagctcaaaaacgacctgcaagcctagttggggaaaacttggtcttatgcccagaattatccccaatttatccacaggtggaaaacttgttcttaatcggacctaccgacttttccacagcatccacaggtcctactaccactactaactatttttattaatttaaattaactatcagggaggactccttcatgaaattcaccattaaccgagctgcctttatcggccaactcaacaacgtcttacgggcggtttcttccaagtcaacgattccgattttgacgggcttaaagctggtcgtcgacaacaatgaggtcgtattaaccgggagtgacgccgacattagcattgaaaccacgctaagtggcgcagacggtcagtaccaattgacggtagaagaaccaggcgccattgtgttgcccgcccgtttcttcagcgacatcgtcaagaagttaccggatcaacaagtaacaattgctgttacagatggttttcaagcccagattatgtccggaacggcggagttcgtcattaatggtcaagacgccaataactacccgcacctgccggaaattgacacggctgctagctttgaagtagcggcggacctatttgccgacgtaattcgccaaacccaaatcgccgtttctcaccaggaaagccggccaattttaaccgggatccacgtttctttagctgatgggattttaacggccgtggccacggatagccaccgcctttcccagcgcaaggttcgcttggaaaatgttggggagcgtcaagttgacgtggtcatccccggcacgtctttgacggaactatcgcggatgattggtgacgttaaggatccggttaagatccaagtgacggacaaccaggccctctttgtctttggtaacacccgcttttactcccgcctgttggaggggaactacccggacacttcgcgcctaattccggacacgtctgaaacgacggtggaactggatgccagtgcctttttggcggcgattgaacgggcgtcgttgctttcccaccagagtagaaacaacgtcgttaagttgacggtcgacccgcaagcgggcctggccaaggtatctggtaactcggccgacatcgggaacgtggaagaaaacatcgcgacggaccggatggaaggaagcgacttggaaatttcctttaaccccgactttatgggtgacgccctgaagtcctttggtcaggccaagattatcctgtcctttacgacggcgttgcggcctttcaccctggtgccaacggaagattccgatcaattcgtccaactgattacgccagtgcggacttactaaacttaaataacaaagcttgtgaaacggtcggcgagtttgccggccgtttttgtaattaaaattaaatatgggcgtttaaacgcgatttgagggcaaaaggtgatttttgccctcaaggggtcaaaaaagctcagaacggctctgaagggggaaagatttgtttttacccctcaaaaaagctataattgtactatcaaataaagtaggtgacgtgtgaacaaatggaaaaagaagtcaaaattgacgcacccttcattaccctaggtcagcttctaaaagaagagggcatcatcccaactgggggcgctgctaagtggttcttaaaggagcacgaagtcaaggtaaatggggagttagataatcgtcgggggaagaaactttaccccggcgatcacattgatgtcgtcggaatcgagcaagttgttatcgcgaccaactaggagcagccgatgattctccaggagcttcagttaagtcattaccgtaactatgaggaactggcggtgacctttgcgccggggatcaacgtcttaattggagaaaacgcccaggggaaaaccaacctgctggaggccatctacctgttggccttcaccaagagtcaccggacggccaaggaccgggagttaattggctggcaccaaaagctggcccgggttagcggcgtggttgagcgagcgagcggccgccttcccttagaggtgcaaatctccaccagtggcaagcgggtaaaggtcaaccacctctttcaaaagcggctttccacttacgttgggaacctcaacgtagttttgtttgcccccgaagaccttgccctagttaagggggcaccggtgaaccggcgccagtttatggacatggaatttggccagatgagtagcaagtacttgtacaacgtcagccgcttcaaccagcagctcgcccaacgtaacgcctacttgcgccagttcaggtatggccaacaaagtgatcggattttactcggggtgatcacggatcaactcgcttcggtggggggcgaagtagtggtggctcgccaacagttagtcaagcggttgggaaagtgggcggctgaattacaccaccacatttccaagcaaaaagaagagctgagcttacagtacgttagccaagttgaagtggacgatcaaacgaccgaagaggaagcggtcgcccaactgcgccgcctctattcagaaaacgaggagcgagaaatcgagcacgggaccagcctgattggcccgcagcgcgatgacatccacttcatcgtcaacggtcaaaacgtgcaacgcttcggttcccaaggccaacagcggaccaccgctttggccgttaaattagccgagattgacctgatgaaagagcagaccggtgaataccccctgctcttgttagacgacgtcttgtccgagttagatgacgaccggcaaacccacttactgacggcgattcaagataaggtgcaaacctttatcaccactactagtttgagtggggtggctcggcaactaattcaccacccaaccatcttcacgattcaaagtggcacactcacaaaggaggaagactagtgacccaacaagaagaacaagcacgtaaagcggaactagctagcgaatacgacgccagccagatccaggtcttaaaggggttagaggccgtgcgtaagcggcccggtatgtacattggttccaccaccgtccagggactgcaccacttggtgtgggaaatcgtcgacaacgggatcgacgaagccctggccggtttttgtgatgaaatcaacgtaattgttgaaccggataactcgatcatcgtgaccgacaacgggcgggggatcccggtcgatatccaaaaggagaccggcaaacccgcgcttgaaacggtctttaccgtcctccacgccggtgggaagttcggtaacggcggttacaaggtttctgggggtctccacggggtaggggcctcggtcgtcaacgccctgtcaacggagctagacgtcaaggtcgcccgccaaggcaaggaatactacatggactttgcaaggggccacgtcaacaccgccatgaaggtgatcaaagacgacctgccgcaatcggcccacgggaccacggtgcatttcgtcccggacccggaaatcttccgggaaacgaccgtctacaacatcaacaccctgattgaccgcttgcgggaactagcctttttaaacaaggggcttaagatcacggtggaagaccgtcgggaaggcaaggagaaacaggaatccttccactacgaaggcgggattcgtcactacgttgaattcctcaatgagggccacgagctactctttgacccgccaatttacgtggagggggaatacaaggggatcacggtggaagtttccttgcaatacaccgatgactaccggtccaacctcttaaccttcactaacaacatccacacctacgaaggtgggacccacgagacgggctttaagaccgctttgacccgggtgattaatgattacgggcgtaagagcgggcaaatcaagggtaacgtcactctatccggggaagacgtgcgcgaaggcctgaccgccgtggtgtccatcaagcacccgaacccgcagtttgaggggcaaaccaagaccaagctgtctaactccgacgctagaacggcgactgaccacatcttcgccgaaacgatgacccgcttcatgatggaaaacccggacgtggcccgcaagatcgtcgaaaaggggatgctagcaagcaaggcccgcgacgccgctaagcgcgcccgggaagtgacccgtaagaagagcggcttggaaatctcgaacttaccaggaaagctggctgataacaccagcaaggacccggccatttccgagctcttcattgtcgaaggggactcggccggtgggagcgccaagcaggggcgttcccgcttgactcaagccatcttgccaatccgggggaagatcttaaacgtggaaaaggcctccttaaaccgggttttggccaacgaagaaatccgctccctatttacggcactaggaactggctttggcgacgactttgacgtcaacaaggctaactaccacaagttgatcatcatgaccgatgccgacgtcgacggggcccacatccggaccttgttgttgaccctcttctaccgcttcatgcggccgatgatcgaaaagggctacgtttacatcgcccagccgccgctgtaccaagttcggcaagggaagtttgttaagtacatcgaaaatgacgaggaactagaacgggtggtcaactccctgcaaccaagccctaagccggttatccaacgctacaaggggctgggggaaatggacgccgaacaactttgggaaacgaccatggatccggctaaccggcacctgttgcgggtgaagttagacgatgccaaggccgccgatgaaattttccagatgctgatggggaccaaggtgggcccgcggcgggaattcatcgaagaaaacgccaccttcgtggaaaacttggacctgtaagaactgatattgaggaggaataagcgtgccagaacaagagatgcctggacggataaccgacgttaatctgaccagccaaatgcggaattcattcttggattacgccatgagtgtcatcgtctcccgggccctacctgacgttcgtgatggtttaaagccggttcagcgccggattttatacgggatgaacgaactgggggtcactccggataagccctacaagaagtcggcccggatcgtgggggacgtcatggggaaatttcacccccacggggactcttcgatttacgaggggctcgttcggatggcccaagacttctcctaccgttacatgctggtcgacgggcacggtaacttcggctccgtcgatggggacggggcggctgccatgcggtacaccgaagctaagatgagcaagatcgccgtcgaaatgctgcgcgacatcaacaaggacaccgttgatttccaagacaactacgacggtactgaaaaagaaccggctgtcctgccggcccgcttcccgaacctcttggtgaacggggcctcggggattgccgtcgggatggctaccaacatcccaacccataacctgggcgaagtaatctcggcaattcacatgctgatgaataacccggacgtgacggttgccgagctgatgaaggccttaccaggaccggacttcccaaccgggggcgtggtcatgggtaaagcggggattcgccaggcctacgagagcggtcagggttcgattatcgtccgggccaaggtggaaattgaggagcaaaagaacggcaagcaacggatcgtcgttcacgaaattccgtacatggttaacaaggccaagctgatcgagcggatcgccaacctcgcccgggaaaaggaaatcgatgggattaccgatgtcaacgacgaaaccgaccgggaagggatgcggatcgtaattgacgttcgccgcgacgccagtgccgaggtgatcttaaacaacctctacaagatgaccctgatgcaaacgacttacaacttcaacatgttggcgatcgttaagggcgccccgaagatcctgtcattaaaagagatccttcagtactacttggaacaccaagaagaagtggttcgccggcggaccgaattcgacttgaaaaaggcccaaaaccgggcccacatcgtcgccgggttacggattgccttggatcacatcgacgcgatcatcaacatcatccggagctcggaaacttccgaactggctaagcaacggctgatggacgactacagcctgtccgatcgccaagcccaagccattttggacctgcggctggtacgcctgaccgggttggaacgcgaaaaaattgaagacgagtaccaaaaactagtggccgccattgcagattacaaggacatcttggcccaccaggaacggattaaccagatcatttacgatgaactgatggaaatccaaaacaagtttggtgacgagcgccggaccgaattacaagtcggcgacatttccaacatcgaagacgaagacctgatcgaagaagaagacatcatcgtcacactcacccacaatggttacgtcaagcgcttgccggttgacgaatttaaggcccagaaccgtgggggccgcggggtgaaggggatgggcgtccacagtgacgacttcatcgagcacctggtcgctagttccactcacgacctcttgctcttcttcaccaacaccgggaaggtctttgccatgaagggctacgaaattccagagtacggtcgggccgcccaggggattccgatcattaacctcctggacgtcgacggcaaggaaaaggtgaccgccgtgatcaacgttgcccaaagagaagacgacttacaaaaggacctcttctttgtgacccggcagggaacggttaagcgcacgccggtgacggaatttaagaacattcgctctaacgggatcaaggccattaacctgcacgagggtgatgaactgatcaacgtggcgattgtcgatgacgatcaaaacatgattctagggacccacttgggccacgccgccacctttaaggtgagtgccgttcggtcaatgggacgatccgccgccggggtccggggggcccgcctacgggacggtgactacctgattggtgccgcaccgttaaacgaggatgaccaggttctggttatctcggaaaagggctacggcaagaagacgccggccagcgagtacccaattaagggccggggtggcctggggatcaagaccgtcaacgtgaccgaaaagaacgggccactcgccgggttaaccaccgttcagggggacgaagacctgatggtggtgaccgataagggggtcatcatccgctttggcgttgaatccgtctcccaaaccaggcgctcagcaattggagtccacctgatcaagatggacgccgactcagtggtagccacgatgaccaaggtcgaaaaagagaccgcagaaacggatccaaccgaagcaagcgctgaagaagccgaaacgccggttgaaggtcccaacgaaatttaattaaaaactttcgtgataaagatccggaattgcgtacttagagattagggaagcaattccggatcttttgttaccctagatttaacttgtgattgaccaaaatttatgctaatattctattctgtgagtatacgtaacgacgtctactctccttgttcccttcgaagagcggagggggccagagtccataaggaggtgtaacattcatggaaacgcgcaaatatgaaattacttacatcattcgtcctgatatcgaagaatctgcaaagagcgagctggtagcccgcttcgacaagatcttggcggacaatggtgcaaccgtagttgactcagctgactgggacacgcgtcggttcgcttaccaaatcggcaagtacactgaaggtacttaccacatcgtaaacgtgactgccgacagcgatgcttcattaaacgaattcgatcgtttggctaagttcagcgacgacatcctgcgtcacatgatcgttaagcgcggctaagcttaacggttaacagtagaagaggggagtgcgatagccgatgctaaatcgtgtagtattaactgggcgactaacacgggatccggaattgacctacacccaaagtggaacccccgttttacggttctcaattgccgttgaccggcagtttaagaaccgggaaacgggccggcgggacgctgacttcattaactgcgtcatctggcgtacgtcagcagaaaactttgcccgctttacccacaagggcgcactcgtcggtcttgatggccgactgtccaccagtaactatgaaaaccaacagggacaacgggtttaccggacggaagtaacggtcgaaaacttcgccctgttggaaccgcggtccgctaataacggtaatggtggttacaacggtgggggttataacaacggcggcaatggttttaacaaccaggaccagtcctttggcaataacgcctacggtaacggtggcaatttcggggccgctcctcaaaataatttcggggggtcaccggctcccgccaaccagtcgtacaacggaaacttcaaccaaccccagggaggcgtctttaatcaaggcccaacccaaattgatgccgatagcctgccatttagcaaggataacgacaccacgcccgctgctggtgataacggcgccgtcaacattgacgacaacgccgccttcagcgcaaacccggggtccggttcggcaagttctgcaagcgacgctgacgggatgccttcatcagatgacctacccttctaaagaaaagacaactactaaacaataagggaggtaatttcatggctcaacaacgtcgtggtggccgtcgtcgccgtaaggttgacttcatcgccgcaaaccacattgaatacatcgattacaaagacactgatttactgcgccggttcatttccgaacggggtaagatcttaccacgccgggtgaccgggaccagtgctaagaaccaacgccgcttgacgattgccatcaagcgcgcacggatcatgggcttgctgccattcgttgcagaagactaggattcccaataaaaaacgttatcgcattgatttgcgatagcgttttttatttgcccccgaatccgttgggggtatgatatgattaaaaagataccgtaagttacttttaaaggggggcagggaaatgtttgagcgttggtttggccgggaaagcgtccggcgactcttgggtagtcgggtctttcaactaacccttgcctacgtcatgttgatgtcgttggtgacggtcatcgttggctttgcctttaactggcgggtggggctaatcattttagcctttattctgctttgcctcttggtggccttagccctcttgcagcggctggcttcgagcaccgaagcctacgttaacgacttggcttaccaggtccgtcaggggcaagaagaggccctctttgaaatgccaattgggatgatcttgctcgatgaaaacggggtggtgcgttggattaatccctacatggcccgctactttgatcagcgcctagtggttggccaagacctgaccgcggttgatgagcggctagcttccttggtcaataagcaccgccgcgacgaacactcggtggtcgtcacctggcaagcgcgccagtttgagttcttggtccaggaccgcttgcatgccgtttacttaatggacgtgaccgaatacgagcagatcaacgaccgttatcggcaagaacggctcttcttggggaacgtctacctcgataattacgttgaattagttcaggggatgagcgactcggaagtttctaacttgcgcaactacgtgacctcagagctaaccgcttgggccaagtactaccaccttttggttaaggtaattgacgatgataactacctactgattgggcacgagggggacttaaaccgcctggaagaagataagttccgggtcctcgataagattcgccaaaacacgtcgcgccaaaactcgccggtgaccctatcaattgggatcgcctacgggcaaagtgacctggttaaactagccgacaccgcccaaaagaacctcgacctcgccctcgggcgtgggggggaccaggtggtcgtccgggccgaaaacgggcaagcccgcttctacggggggaagaccaacccgatggaaaagcggacccgggtacgggcgcggatgattgcccaggccctacgagaattgatgaaccaagccgaccagatcttcgttgtcggccacgccaagcccgacatggattctctgggggcgtgcctggggattcggcggattgccgaaatgaaccagcaccagtgttgggtagtctttgataaccaacaggtccactcagacgttgcccgtctgatgggggaaattaacgaataccagtcgattaaagaccacgtgatttcaccagccgaggcgctagaaaaggcgagcgctaagagcctgttggtgatggttgaccactccaaggtgtcaatctcgatggcgccggaactttgtgctaaactatcaaaccgaatggtgattattgatcaccaccggcggggcgaagaattcccggaaaacccgctgttggtttataacgagccctacgcctcctcgacgtgtgagctaatcaccgaaatgtttgagtaccaaccacgggaaagccaggggctcaaccgcttggaagccaccgccatgctgacggggatccgggtcgacaccaagtcctttagccaaaacgccggtacccggacttacgatgcggcctcctacctgcgttcggccggggccgatgggatgttaatccaacggctgatgaaggaaaacccggccagctttttagcgcgtaaccacttgatcgcggcggtgaccttcatcaatgacaaaatggcactgtgcgtgggcgaagacgaccgggtgtacgatccggtcacggcggcccaggcggccgatatgctcttgcaaatggatggcatcgacgcctcctttgtgattaccagacgctccaacgacgtcgtgggcatttcggcccgctcgctaggggactttaacgtccaggtaatcatggagcagatgggcggtgggggtcacttagccaacgccgcgacccaggtgacgggcaagacggtcactgaggtcaaagaccaactagagcaacttttaaatggggaacagctccccaacggaaaagaagaaacggaggaagactaatgaaagttatctttactgaagacgtcaagggacgcggtaagcgcggggaaatcaaaaacgttcctgatggttacgcccaaaatttcttgatcccccgggggaaggccaaggaagctaacaaggcggccatgagcgaattagccggccaggaacgctccagggaaaagcacgaggccgaagaattagcggcggccaaggagttaaagaaggtcttagaagacgataaaacggtcgttgagttaaccgggaaggccggaacggatggccggatgtttggttcggtttcgaccaagcaaattgccaccgccttagaaaagcagtaccaaatcaagctggataagcgcaagatggaattggcggccccaattcgggccctgggctacgtgaacgtcccggttaagctacaccacgatgttgaagcgaccttgcgggtgcacattgctgaaaagtagttcgtcctggcaccaggtcaaagtgaaagggcaaggaatgggaaatggatactcgtccagaaattagtcggacgcccccccacaacattgaggctgagcaagccgttttgggggcgatcctgttaaaggatgacgcgattgtcgaggcgatggaatacgtcaaagaagacgacttctacacccgccagcaccagctcctctttaagaccatggttgccttaaatgacaacgataagccgatcgatgttgtttccatgcaagtggagctcaaccgccaaaaccagctcgaggcggtgggcggaattcagtacctcgccaagctcgccgcggcggttcctacggcggctgacgtcggcttttacgccaagatcgttcacgataaagcaacggcgcggcgtttaatcgatacggccaccaagattgctagtgagggttacgaggatgccgatgagatcaccgacatgctcgaccgggcggagcagtcgattttaaacgtggcggaggacaataaccaatcggagatgcaaaacatcgaagaagtggtgcacgaagccgccaaccacacttacgagctctctaagcagcaaacccgggtgaccgggctgcggaccggctacccgcaactggacaacatgacgaccgggttacacgaagacgaactgatcatcttggcggcccggccggcgatggggaagactgcctttgccttaaacatcgcccaaaacgtggcggtccgtggggataaccagccaaccgtcgccatcttcagcctggaaatgggggcggagtcgttagtcaaccggatgctgtgtgccgaaggggggattaacgccaaccacctgcggaccgggaacctcgataccgatgagtgggacgcactttgggtggccatggggagcctggcggggaccaacgtctacatcgacgacaccgccgggatcaaggtccccgaaatccgggctaagtgccggcgcttaaagaagcggactgggaacctgtctttgatcgtgatcgattacttgcaactgatcgaagggagtaactcggaaaaccggcaacaagaagtctccgaaatctcccggcagctaaagaagctcgctaaggaattatcggtgccggtaatcgccctttcgcagctttcgcggggggttgaacagcgccaagataagcgcccggttatgtccgacatccgggaatccgggtcaatcgaacaggacgccgacatcgtagccttcttataccgcgacgattactacacccgcgaacaacaagaggacggggcgccgcaagcgggaagcgaccaggaggccgaaaactcgctgtcggaagtcgaagtcatcattgaaaagaaccggagtggtccgcggggaaccgtcaaactactctttaataaggcctacaacaagtttgcctcggtcgatttcacgccggggcaggggccacaataactaagtaaaagttaccgtaacgtcctttagggatgcttacggtacttttgtgttgtctaaaattaaggaaactaggtgaggaaatgcaaacagaaattaagtttcgttggctgttgctcggtagctttttggttaacgttgggaacagctttatttggccgctgacgacggtctacatccacgatcaactacaccagtcactgacggtttctggaattgtgctcctcttttattccggaactaacgtgatcggttcctacgtcggtgggcggttatttgacaagtactcgccccaatggctaaccctcggggggatcgtggcggcggtaatcttcatgggggtgttggtctttaaaaacgactggccgacctacccgatcatgctcgccctgattgggatcgtcaacgggtggttgatgacgatgcacaactcctacggtgcccggatgcacagtcgggatgggcgcttcgtttttaacatgctctactttgccaataacttggggatggtctttgggaccacgattgtcggcccgctttaccagtatgcccatgataacgtggggccactgttcttggtgaccgtggtcatttacgccgccttttccttagtggtgatcaagttctaccaaattgccgtcatcaaacggccccagcacgaagaaaaactggttaagttgccccgagccaattcccagctgatttggacaatgagcggcgccctgttggtgatctggatgatgtactcgcaatggtcgtccaacatgtcggtttacattaccggtcacggggtttccatgactagctactcgctgttgtggacgatcaacgggctcttgatcgtggtcttgcagatggcgattaactggttaaaccggcggatgaacaacgatcacctttacttgtactttggcaccgccatgttagggctgtcctttttgatcctgccctttgccaagggctacggggccttcgtcttctcaatggtcgtgctaaccctgggggaggcaacggcgattccaacgatcccggccctggtcaaccagctgtgcccaatggaagataaggggcgctaccaagggatcgtcaattcttttggttcggccggcaaggcgctgggccccttatttggtggcctggtgatcgaacggtttagctatcagcccctcttttacgtctgtacgttagcaatccttggtgccggcttagtttcctggttgatgattgaaaagaatcaccgccaggctgaatactactagggggtgagcgtttgttttaccaaaattacgatgaagttcatggcgaggaccgctgggggatggtcggcaaggtcggcgacccctttagggaggattgcctactagcggcaccctgctacaagtgtcaccgccagccactggtgatcgccgagcgcaactgggaggccaccaacaacgacgactcgcaacagtaccagattctagtggcctgtacccactgcggggcggtcgataagtttaccgtcaaccagggaagagaaggggtgctcagtcaactcaagcacagccaccaacgggtgagtgttaacgacgtcaaagctgaatcgcaagagggtgggaagtaaccttcgaaaagataacaaggagagtgggaaataaccttctcggcaggtcgtatgactaagctaggacgaacggttagtgcagaatgcactgttcttcggcctgcttaggcactaggcctgcggttatttaccacgttttctgtctaacattcgggaatacaacaaggggctgggagaaaacacggttttctcccagccccttgtttttaggtataaaaaaaccgccacccaagcggtgacggaatgaaatgggcagtcaggggatcgaaccctggacacccggattaagagtccggtgctctgccagctgagctaactgcccatgtcttaacaacataaaatataataccagttgaccatcgttttggcaagcccctttttaaaaaagatcggagaccagggaaagtgggccccaccgccaattgaggatggccatttttatgacgaatttacaattgaagtgcaacaagtaagaagaaaataaaaaagaactcatagcctgagtcctgtaaaatgaagttaccacaacaaacatctaaaggagatcttaggctatgagttcgtacaaccatcttaccttaaaagaccgagaatgcatactattaggcgtcactttgaaggacacctatcaagttattgcgcagaggattgggtgttctaaagccaccgtatcgcgcgagatcaaacgcaatggcggtcgtaaggcttactcagccgtcaaggcccaagagaactatcagggacgtcgactaaaaagccgacgtcctaggcttctaactaacttgaagttacgggattttatccttcactgtattgttcaacgtcagtggtccccggaacagatttcaggtcgtttagcccacgaaaacagcgaatggcgtatcagttataacaccatttatcgtgggattgaacgcgataatttaggcatcaaacgtaagagtcacggggctcgtggctttgcccgtaagctccgtcaccgtggtaaaacccgaaaggccaagggaaccattaaggaacgtcgaggacgatttaacgacgtcccttccgttcatgaacgcccggtttcatgtgagaatcgaagccggtttggtcattgggaaggtgatacaattcgcggtaaaaccgggcgttcagccctggtaaccttagtggaccgtaaatctcggtatttattatctcagcgcgttctcaaagtaaacgccaagaacgtcacacaagcgatgattgacctcctgcataccgtaacgcctaaacgcgttcggacgcttacgccggaccgtggaactgaattcgcaggataccgtgaagttagccaagaactaagcattccagtctattttcccgatccccatgcgccccaacaacggggaaccaatgagaataccaacgggcttatccgtgagtatttccccaaaggaaccgacctagaccaactaactgatcaagatatcgacaagtttgtcagggatttaaatcaccgaccacgtaaggtcttaggctggaagagtccatttgaagttttcttcgggacaaagttgcgcttgatttgacaattcgtcatacaaaaaaaccgccacccaagcggtgacggaatgaaatgggcagtcaggggatcgaaccctggacacccggattaagagtccggtgctctgccagctgagctaactgcccatgtcatgtctaacacaacgttattaactatatcagatatggtctaatttggcaagacctttttgtgaaaaaagttggagggccgggatccacccacccggtgtggtataattaagtttacgatcaattaacgaagaatgaaaaaagatggatgcggagggaccgacatggccaagaaagttttggttgttgacgatgaaaaaccgatttcggatatcattaagtttaacctagaaaaggagggctatgaagtcgtcgtggcttacgacggggaagaggccctgcaaaaggtcgaaagcgagtcaccggatctgatcgtcttagacctgatgctgcccaaaattgacggcctggaagtggctaagcaggtgcgggctaagcgttcgacgccaatcatcatggtaacggctaaggattcggaactcgataaggttttgggccttgagttgggggccgacgattacgttaccaagccgttttctaaccgtgagctagtggcccgggttaaggctaacctgcgccgccaagacgccaccgtttcaccggcgaacgacgaccggaccgccgatatcaaggtgggggatttgaccatccacccggacgcctacacggtcaccaagcggggcgaaaacatcaacctgacccaccgggagttcgagctcttgcactacctcgcccaacacattggccaggtcatcaaccgggagcacctcttgcaaacggtgtggggctacgattactttggtgacgtccggaccgttgacgtaacggtgcgccggttgcgtgaaaaaatcgaagataacccgagtcacccccagtggctgatcacgcggcggggggtcggttactacctagccaacccgaatcaggattaagggcctgaatcgtgaacagtaaaatcaaattctaccagtcgatccactttaaaatcgcccttgtctttgcgctgatgctgatgctgacgctcgaagtggtgggggcggtttttgtgcgtcaactggaacaccaagaactcgccaacttcaagcaacaaattgagttgccgtcttacatcgacaattccttggccacccaactgaccagcaccgataccaaaacggccaacaaggaaattaaaacgatcctcgcccgggtcaacaacaccagtatcaccgagatccgggtggtcgatgccaaggggatcattcgcgggaccagtagttcgggcaaccaggggatcgtcgggcaaaagactaccgacacggtaattaaaaacaccctggttaacaaccgctcccacaccgaaaacctctacgacagcgccaaccacaaccgctactacgtcagtgtcgtgccgctgttagccagtggcaacgccaataacgtggtcggggtcgtttacatgcgggccaacctcgagggggtctattcgacgatcaactcgatctccttgatctacctgtcggcagctttgatcacaattgtcctggggctggggttagcggtcctaatttcccgggaaattacccggccgattgaagaaatgcgcaagcagaccctacggattgcccgtggggacttctccgggcaggttaaggtgatgggcaacgacgaactaggccaattggccggggcagtcaacaacctctcggtgcgggtggaggagtcccaagagtcctcggatgccgaacggcgccggttggattcagtcctctcccacatgtctgacggggtgttggctaccgaccgccggggtaacctgacgatcgttaataacaccgccctccagtttttaaacatcgctgacgaagagcaggtgctcggcaagtcgattttggacgtcttaaagattcggcgccaattctcgattcgccacctagtcgacgaagaccaagaccaggttatcttggatgatttaaacgaggacctgattttatcggcctacttctcgccgattaagcgggaatcgggctttgtctcgggtctagtttgcgtcttacatgacgtgacctcccagcaaaaagaggaacgtgaacgtaaggagttcgtttccaacgtttcccatgaattacggacgccgctgacctcggtcaagtcctatgtggaagccctcagtgacggggcgatcaacgacccagaattagccccccgcttcttaggggtggtatcagatgaaaccgagcggatgatccggatgattaacgacctccttagcctgtcgcggatggattcgggaacggctaagttaaacttggagtacgtcaacattaacgagctgtttaactacattctcaaccgttttgacatgatcatcaaaaacgaggccgcggatccgagccaaaagaagtacacgattgtccgttacttcaccaaaaaggacctgtgggttgaaatcgacaccgataagtttacccaggtggtcgataacatcatgaacaacgccgttaagtactcaccggacggcggggtcattaccgcccgcctgttggagacccacaaccacgtgatcctgtcgatttctgaccaggggctggggattccaagaaaggacctcggccacatctttgaccgcttcttccgggttgataaggcccgctccagaaagcagggcggtaccgggctgggcttggcgatttcaaaggaagtcgttaacctgctaggcggccaaatctgggttgattcggttgaaggcaaggggtccaccttctacatttccttgccatacgtaccatacgaagaggaggaatgggatgatcaagcagattaaaaagagcagcctgacgattgccctggtgatcgtggtggccctgtcggccgttttgtcggccagcgtctggatcaatcccttccactacgagcggggcagcggggacagcacgagtacctcgacgcgccaagacaccgttcaatccctgagtgacatttataagcccaccgaggtgatccgtacctaccaggaccggtcgcaaaagcttctctatgaccaggctaaaaacccggtcatggtgattgaacaacaggtccgcaagtggaagttaaagcaccttacccgggtcgttaacaacgattcggcggcctacttgcgggacctacgcaccgaaaactcaatcatgatctcctaccccgatgccgtagccaccacggtctttaaccagacctttaatcagagtgtcgatacggcccggctcaagtggatcaaccacatcgtcattaccctggataagacgccgaccgtttacttgatggccgacgaaaagtaccaggtctaccggctgacgacgaccagtcaatcacttgcggtgatcaaaaagtccctggtgggggggagccagttaaacgttgaccacaagatcgtcaacgggattcctttgaccaccttcccccaccagatcagcatgcccacctaccgttcaacgattaaccaccaaaacctggacagcatagcccaaaccctgatggcctcgtctagcgtttcgacggtcagttcgcaaacgaccagtaagctaattacctacatggctggtaattcgcggcggatgacttacaataagggcaccggccaggttcaatacgacaactacctgggaaaggataattcctacggcacccagactttgtacacccacctgtttgacctgttggccgacactgcggtccccctggaacaagttcaatacgacaacgtctccttggtcggtcaaacgattacctaccgctcctttgtcgagggtttcccgatctttagtgacaatgactacgggacggtccggattaaggccaataacgacggggtcgaacgctaccacctctcgccgttaagcctggggaccccacttccggcgagtggccaaaaggtaaccttgccctcgacggtcacggttttaaacgccctgtaccaagcgggaaagggcaaagacatcaagggcttacggctgggctacacctgggcgaccaaccaaaataagtcgctcgtcacgctttcgccaacctattacgtctactaccacggtaactgggtcaagtatcaaagcctgttaaagggggattaagatgaactttcgcagaattcagtggatctttttaatcgcctttatcatcttggacctggtactcgtttcaaccctcttatggggcaacgagaacttttccaccagcggcaagcaacagagccagacccagctgaccctaaaggaaatgaagtccaattcgattacctaccccaagttgagccccaactcccaaacggggtactacttagcggtgacccccggggacctttcaacggagcgggggcggttgaaaaaccaaaccacccggaccgatgggaacctgttgaccgctaactttgtcgacgccgtagacctatcttcttcccagtcagtccccaagcaactaaagaagctactgaaggattcgcgcctgttcttgcacgggactagctatcaatacagcgccgctttgtcgactagccacagcatcgtctttacccaggtaattaagggtgaaccggtgttaagccacgaggggcaaatccggctccggctcaacgccgctaggactaaggtggtcggttacacccagggctacttaaaagaggagcgtgttttgcggccccagtccgggacgatcagtcaggtccgggcggtcacctggttgtaccgccacaacgaaattcctaacagtacgcagattgtccgggtgacctacggctacagcccgctgatgactagtaatggtaagcagatcttcgtgccgatttaccaggttcagttgcgggccaagagcgccacgacaacacaaaacttgcggatcaacgcctttagtggcacgataattcaggaaaacaattaagaagggaacgaagagtggtgcaagcaacagtggcagatacaattcattacagcatcttagcctccggatcggggggcaatgcgacctacttggaaacggcgggtcaccggatcttgattgacgcgggcttgtccggtaagcagctggaacagcggatggaagcgatcgggcggtccttagaccaggtcgaggcgctgtttgtaacccacgaacacagcgaccacagccatggggtgggggtcttggcgcgccgttatggaatgccggtatacgccaacgcgggtacctgggcggccgtggagggcaagatcggtaagatcgctccagaccaaaagcaactcctggcgccgggcaagttcttagacctgggcgatctgcaagtcgaggcctttgccgtctcccacgacgccgcgcagccccagttttaccaaattcaccacgacgaccaatcctttgtgatcctgaccgacaccggttacgtttccgaccgggtcgttcagacgatcaaaaacgccgatggctacttgatagagtgcaaccacgacccggaaatgctacggatggggccctattcatggccgcttaagcaacggatcctaggcgacaccggccacttatccaatgaagagggggccggggccctaatggaagtgatcggcgagcggaccaagcgggtctttttgggccaccgcagccagcacaacaacatgcggtccctggcgcacctgaccgtggctagcatcttggaaaaccatgatttcggtgtcgaccacgactttaagttggcggacgcggagcccgatcaacccagcccgctcttgagtctataaaaagttagtagctgattaatagaatattcgtaaatgtttgctacccttagggaaaaaggatcgggggaaaaacgatgaagaagcacttagcaccacagcagcgccgtttttgggggaaggtcatcctcgtcggcgtcttggccggtctccttggtgggggggcggccctcgggattaactccgccatcagtacctaccgcaactacgccaccacgaaggtgcccgcgggctcgtccaagagcggcggcacctcggtttccaagaataaggccagcctgaccaacgaaaccactaaggcctataacgccactaagaacgcggtggtctcggttatcaataagcaggccacgtctagcagtgactccttgtacggcaacgtcaccgacgggtcaactagctccggttctggcagcttagaaacggctagcgagggctccggggtgatctacaagaagagcggcaacgttgcctacgttgttactaacaaccacgtcgtctccggctccagtgaaatccaagttatcttgagtaatggcaagaccgtcgacgcccaaatcgttgggaccgatgaaacgaccgacctggccgtcttgaagattaacgccgccaacgtaacgacggtggccacctttggtaactctaacgacattgcggccggccaggacgtgatcgcaattgggtcaccgatgggttccgagtacgccaacacggttaccaaggggatcatttccgccaccaagcggacggtcaaggccagcgacagctcggtggccacgaccgttatccaaaccgacgccgccattaactccggtaactcgggggggccactggtcaacatggccggccaggtgatcgggatcaactcgatgaagctagcctccagcaccgatgggacctcggtggaggggatgggcttttccatcccgagtaacgaagtggtccgggtcatcaaccagttaatcaaaaacggcaagatcacccggccaatgctaggggtgtcactcttggacctgtccgacgtttctagtagtcaacagcagtcggtcttaaacctgccaaccagcgtaaccaagggggtggtggtgatgaaggtggaaagtggctaccccgccgccaacaccggcttacaacaatacgatgtgattaccgccattaacggcaagaaggttaccgatgccggtgacttaaagacggtgctctacaagtacaaggtcggcgacacggtcactttgacctactaccgtgacggaagcaagaaaacggccaaggtagaattaaacaaggaggctagctcgtcgaccacgaccagcagttcttctagtgatgacgcaaccagcgccgagtaactgagtagggggaccctagcgttcgtgaattacgggcgttggggtcctttccgttactaagtgttcgtgaacgaagcgaaaccgaaggggagtagcgaaacgagaaaaaattagcccggtccaaaaagttttccacaagagagcaaagccccggggcagtaaggaaacgatcatttcacaaacttatccacaggatggtggataaccggtggaaaagtggacgagtgaggaaaccgaacgccgtaaatgcaagcggggcaaggggttggtggatgacagaacgaacaatcgtttctgtggacaatgtggaaaagtcgtgcaaatgaccacttattcacaggggggtaccgcaacttatccccaagaaacggtggataagttggggataacttgttgaaaagctggggaaaactgaactttaacggtggatatagtcgctgaacatgaaagagaggcttttcccccgctaatttgagcgggtggggaaaagtccggagaggagaaaaaatgaacattaagattatcggggtcggcaaggtcaaggaaaagtactttaaggccgggatcgccgagtacgccaagcggatggagcgctacgccaagtttgaaattgtcgaggtaccagacgaaaaggcccccgagaccctcagtcaggccgaaatggacgccgtgatggcaaaggagggtgagcggatcctggcgaagatcaaggaccgggaatacgtttatgccctggcgattaagggcaaggaacgttcctcagaggagttcgctaaggaaatcaaccagctggccacttatggccactccgatataacctttgtgatcggcggttccttggggcttagtccggccgttttaaaacgggccaacacccagatttcctttgggcgttttactttgccccataagttgatgcgcttggtcttagccgagcaaatctaccgggccttcacgatcattaatggcctgccctaccataagtaggggcgccgagcggttaatgaaaaagttcctaaactacgtggcggaaggaaaaggataagtaattttgaaaaacttagcgcctgattaatccgccaaccggttgagtagtatataattaagttagttgggacgcccccaccggcgtcccttttgcgtcctctaattagaaaatggtatcattgtaacaattattctacggaaaggatggatgatgatgaagtactcgcaccgcgttagtgatggggttcacgtccttagttacgtttacttacaccaagacaccaaaatctcgtcagcccggctcgccagcagtattgattccaaccctagtttggtgcgacggttgatgtcgcgcctgaccaaggccggcctgctcgtcacccatcctgggacggcttcaccagccctggctaaggagccggaagaaattaccctgcttgacgtttaccgggcggtggaagaccagtatcacctcctgcacatcgatgaacaaaccaacccggattgtccgattggtaaaaacatccagggggtcttaacccaggagtttgccaaggtccaagcggcggccgaggcggcgatgcaagagattaccctggcggaaatcaccgctaacttgcaagagcgaattgagggatagtagcgatggcgacgatcaaagatattgcgaagttagcgggggtgtcgatttcgacggcttcacgcgccctaaacgacaacccccgcattagcgaagcgacccgaaccaaggtcaagcagatcgcggcggaactgggctactcccccaactacaacgcccaaacgttgacccggggagaggccaacatggtcgggttggtctttccggtgaccgaccaaagcgccctggctaacccctttcacatcgatttgatgcgcggggccggggtggctttagagcagcgccactacacgatgatggtggcgattaccgaaaccgaagaacggctgttagaaacggtcaagtcgatggtcacccaatccaaagtgcacaacttcttgttactgtacaccaaggaaaaggacccggtcaccgactacctccgggacgccggaatgaactttgtcgtcatcggtcacccagaaaagaagggtgatcgcttcgtcgacaacgacaacattcaggccggttttttagcgacccaaaagctgctggacgaccaccactgtcagcacgtggctttcgttacctcgccgcaccactggacctttgaagtcgaccgccggttagggtgccgccagtgcctcaacgaacgcggcctgggtggaaccgagtgggtggttgaagaagacaacgccccacaattttttgcccaacacccggaaattgacgggctggtctgtgccgacgacatcttgttcctgcagatctaccgccaactagaagccttggggcgccaagaccaattagcgatcatttgctttaacaatagccggttgctgggccggctcttacccgcgattgaccgggtagatctgcgcccccgtcagttggggatcgccgccgtggagctactcttcaaccgccaagccgaccaccaatttatttcctttgccctgtagtaggggacaatcagcctacttaaatgaatcccggactaaggcaatcgtgattgattgctctagtccgggctttttgtgatctaggcatttcttaaatttccgcggtgggtcgcacttccaataacgtgctccccaaccacgggcctagtggctaagtacggccggagaacgatgcgtaccgcatcaacccccgtcctagcttagcccaacggcccgtcgaggaggttgggtcgtacttccattttttttgtgcaaatttcgtgcaaacggttgcacaaaaggagatagtctgctatatttactcctgacgaaaagataaatcgctttctttggggagggatccacccaaaggaggagacaagcagattggagtggagaaatgagttcgcaaaagacaacaactggtttgccaaccctgcccaagagcatgatctggatgatcaacttcggttttttgggcgtgcaaaccgcctttaccctgcaaagttcccaaatgagccggatctttcaaacgattggggctgacccgaataacctgggcgcctaaactggggggccggcgcctgccttacctcttattggggacgattgtcgccgtgatcgtgatgatcctcttgcctaactcggggagttttggctttggttacggctcgctagccgccctgtggttcggggcaatcacggtcgcctttttggacctgtcctcaaacgtggccatgcaaccgttcaagatgatggtcggtgacatggttaacgacgaccaaaagtcctacgcttacgggattcagagtttcttatccaacaccggggccgtcttagccgccatcttccccttcctcttcaccttcttaggggtcgctaacacggccaagaagggggtcgttccccaatccgtcgtggtggccttttatgtcggcgccgccctgttagtcattactagtttatttacgatgctcaaggttaaggaatatgacccggccacttacgccctgtaccacgggattgaagaggccgataaccaaaagggtgaaagctggttaacactgttaaagcacgccccaaaggccttttggaccgtgaccttagtgcaattcttctgctggtttgccttccaatacctgtggacctactcggcgggggcaatcgcccaaaacgtttggcacaccaccaacgctacttccgccgcctaccaagcggccgggaactggtacggggttttagccgccgtccaatcaatcgccgccgtggtttggtcctacgtcttagccaaggtgccgaaccaatatcacaagctcggctacgggggcagcctcttgatcggggccaccgggttcgcctcaattttcttcgttcacaaccagtacgtcttgatcctttcttacgccctggtcggaattgcctgggccgggatgaacacctacccgttgacgatcgtgaccaacgccctgaccgggaagcacatggggacttacctggggctgttcaacggctcgatctgcctgccgcaaatcgtggcctccctggcctcctttgccctcttcccaatgttgggcggctctcaagttaacatgttcctcttagccggaattgtgatgttgctcggggcgctgtccgtcaccacgatcaaagaaacctacgtcaaataaggagaagcaaccatgaaacgaacatttgaagttagcccttggcacgttaagacgaccaagtgggcaccagaagacaagttactgcaagaatcgatgaccgccctggccaacgaaaacctagggatgcggggcttttttgaagaaggctattccgatacgactttgcaaggcgtttacctaggtggggtctggtttccggacaagacccgggtcggctggtggaaaaacggctaccccaagtactttggcaagatgatcaacgccgtcaacttcatgaagctgacgattgaagttaacggcgagcaagtcgactttgccaagcaaaccccaaccgactttaacttagacctcgacatgcagcggggcaccctaacccggacggtgacggccacggtcggtggcgcaccggtcaccctgaagtttgaacgctttgtctcggcggtccaaaaggaactggtgggccaacgcttgacggtgcaaagccctgctgaaatcgacctggcgatcagcgctcaaatcgacgccgacgtttacaaccaagatgccaactacgacgaacagttctggcaggtcctagaccgaaaagcaagcggtaagggcgccctgctggtttcccaaaccaaggcaaacgactttggcaccccgcagttcacggtcgccatgcaaaccagcgtcaagaccgaccttccccacgttggcgacgccgtggaagccaagcaggttgctaaccacttcgccggccacgtggccgctgggcaaagtgtcaccctggaaaagcggacgatcgtgaccacctcacgagactatgccgaccaagcggaactggtggcggcggcccaggacttagttgcccaagtcgaccaggttagctacgacgacctggtggccgcccacgtcagtcaatgggcccagcgctgggccaagtccgacgtggtgattgaaggcgatgacgaggcccaacaggggatccgcttcaacctcttccagcttttctcaacctactacggtaacgacagccgcttaaacatctcgccaaagggcttcaccggcgaaaagtacggcggggccacttactgggacaccgaggcgtactgcctgccggtctacctcggggtggccgacccgcaagtcgccaagaacctcttgtactaccgttaccaccagctaccgggcgcttacgttaacgccaaggagcaggggttaaagggggccctgttcccgatggtgaccttcaacgggatcgagtgccacaacgagtgggagatcacctttgaagaacttcaccgtaacggcgatattgcctacgccatttataactacacccgctacaccggcgatacctcctacgtcttgcacgaaggggccaaggtcctggttgaaacggcgcgcttttgggccgaccgggtccactactcccagcgcaagaacaagtacctactccacggggtgactgggcccaacgagtacgacaacaacgttaacaacgactggtacaccaacctcttgtgccagtggagcctccaatacaccctggaaatcttggaccaagtcgatgaggacgtcttaaaggacctggcggtgaccgaagacgaacggcggctttttcaggcgatcgccgacaacatgtacctgccagaggacgccgacaaggggatcttcccggaaaacgacgccttcttggacaaggatttggtgccggttgcccaaatccctagcgaccagctgccgctcaaccaacactggtcttgggataagatcctgcgctcaccttacgttaagcaaggggacgtcatccaggggatctgggactttatcgacgacttcacgccggaacaaaagcggaaaaacttcgacttttacgagcagttcacggtgcacgaatcgagcctgtcgccgtcggtttactcgatcgtggccgccgacctgggcgacgaggataaggccgttgagctctaccaacgctcggcgcggctggacctggataactacaacaacgacaccgacgacggtttacacatcacctcgatgaccggggcctggttggatattgtccagggctttgccgggatgcggattagagacgggcgcttgcgttacgacccgttcttaccgaagaactggacggcctaccaattcaaccaggtcttccgtggccgcacgatccaagtacgggtggacgctgacggcacccacctgcaactgctgagcggggaaccgttaaaagtcgaattgggtgaccaattaaccgaattaaagtagcggcgcccctccttttttctcaggaatttaccggggggaaggccaataaaccggactttaaggtttccgaagtggctatttcccaggaaatcacttgaccggcgcccgtacaataaaagtaaccacgaacaaaggagattttcgccatgaactttgcagatattgccggctttgcctttgacttagacggggtgatcgccgacaccgcccgctttcacacccaggcctggcacgaactggccgaccaggtccagacgccctggacgccggaactggaggcgagcctcaagggagttggccggatggattccttggagctgatcctaaaggcaggcggccaccagggtgagtacagccaggaagaaaaggtcgccctggccaccagcaagaacgaccgctaccaagagctggtcaagaccttgacgccgtcagacgccctgccggggatgccagccttcttagccgaactccaggccgccggctaccggctggtcttagcttcggcttccaagaacgcgccgacggtcctcaagtacctgcagttagaagacgtctttgaaggggtggtcgaccccgctagcgtcgcccacggcaagccggcgcccgatatctatttggccgccgccgagatgttagaccttgcccccgcccaggttgccggcgtggaagacgcccaggccggggttgccgccattaacgcggccggcgagctgtcgatcggaattggaccggccagcgacctcaaggaagcggcggcccgctttgatcgtaccgaccaggttagcttggctaagctgaaggaacggttgagttaaaagcctgatcttacgtaaaaagccaaccactttgcatgatcaattgcgaagtggttggcttttattcgtctgctagccccatttagttgcggcgcagtagcttgttagttaagtatttgaggggtgtctccgagcggtaagtgaagatgttgttgacgtaggtacgttgagcgaagaggtacatcaagacggcgctcaggagggaaatggccaccgctacgtaaccggccgaatacgaagcagcaccttgggccatgcgaactggcatgatatcttggctcataaacggcaggtaggataggatcttaacgacgagtaggttggggttactttgggttaagaaattgatgaagtaggggatcaacaggatgctggtcaccccggaggtcgcttggccaatgtcttcggcgcgcgaaaccaaggaaactaggtaggccgccagtgaaatgtagaggaacaacgaaaggagtgccagaatcaaagaaatccacaggtactggggatcaattttagccaggtaatcgttgaggtgtagggacttaacgaaggtggagtggcgtaacaagaggaagccgacgaggccgaaaacggcgtataacactagctggaaggcaattaaaaagcagatccccagcatcttaccggtatagtgctttttcgcggggatggcggctagcaggccttcgattaagtggttccccttttcggtaccgagttcagcgccaacgatgctaatgtaactgatcaaaaaagaggctcggggaaagatgttttctctgggtctctacattcgattagttagttcaatttcaccggcgcccaaacgtcggcggtgtcaaagacgagcggggtggctcgctttaacaagtcgtcagtcagctttaccgaggtcacctgggcctggtggtaggactggaagtagtaggtgcggtcctcagcaacggtggcagcccggtacaccgagaaggttggccggtgggccttgctcttggggacggtgaccgaatcgagcaggtgccaggtggtggccagcgcctcgtcttttgatgccggttggtcggccagttccttcatgtaggcggcccggacgtagcgccccttgggggtgtaggcaccgggtggcgtcttcttgcccgagagcttaccggtggtgacgtgaaaggtgttcggcgccagggtaccgttcaaaaaatccggggtgaagtctaggtagtcctgcaggcgttccagctggtggtcgaacttgggcatgttggtcatgatcccgagcgggttatcgatcagcttgagcgggtgctcgctgggttcaatgaccacgcaacgcccggtggggtcggacaagacaaagtgttgctcggagtagccaaagggcacgtcggcgttgacgtcgctcattagttcgatttgatccaggtgcgccgcgacgtcagccaccgatttaaagtggcctagcaagtaaaagattagctcaaaggcggccagttggaccttgtcggggtgacgctcgtcaaccaggcgggcgccgtttttaaaggtcagcttttgggccatcaagccaaactcgttgaccccgtcggaaacgtcggttcgccgctcggtgatcgagccaccaccaatgatggcgtagggattttcgtggacccggtggtcaaagaccgaggcccactggtagtgacggggggtgaagatgggcgacactaagaggtcgtcccagtccattgtccgccccaagacgtggtagccgtcctgggtaatgacgttgatgctcgtgcacatactaatctcaccttcctgcaagcgtttactaatattataagggcggcgccggatttagtaaaaatacttgttcaagaaggcctggatgtgggcgcggtaggccgttgggtcaagccaaaagctctcggcgtggctagcgtggtcgacgatccagagttccttgggggcgtcggtggcctggtaattttccagcgccatgctggccgggacgtaggtgtccttttcgccgtggataaagaagatcggccggtggtttttcttgagctggtcggtcgaggagatgtcacctaggtagtagccgagccggtggcggttgatcgtcgataccagcgggtagatcgggtactcgggtaggtggaactgacgcttgagcaggtaggtcagctcttcgtgaatcgaggcgtagccgcagtcggcaatgatcgctttgacctggggcggtaagtcttcaccgctcagcatctcgaccgtcgccccgcccattgagaccccgaataagaggagcttagtttgggcgccgagccgtttaatgagccggtttagccaggtcaggtaatcgagccggtcgagccagccaaaggagatgtacttgccagcggattgaccgtggccgcggtcgtcgggtaataagacgttaaagcccagctcgtgaaacatcttagcataattcgccatcgtttcgccgttgcccttgtaaccgtgggaaatgatgactgccttgatactgtcgtcagccgggatgaagtaggccgacatctggtcgtcgccgtcatcggtcgaccaggtccagtgctctttttcaacctttttgaaccagtcaacgtagcgccagtactgggcggcgtacttttgcttgtccgccgaggtttccggtacgtaatcgacccgtttgaaggcgaagttaaagaggtactcggccgtcaggtaggaaaggccgagcgtcccggcgaccacgctagctaagagccgtcgtttctttgcttgttgcattgatactatccccttatttattaataaggttatttaacgccctgaggtggggaaaggcaagcaaaacagagtggtaaataacctactcggcaggccgtatgactaagctagggcgaacggttggtacggaacgcaccgttcttcgcccgtacttagacactaggcctgcggttatttaccaggttttctgtctaaaattcgtgaatacattaaaaggccgggaaacacggagttatttcccggccttattttagatataatatggcgcccaacggcctgctttgatggttgggtcgcacttcctagttcgctacttcatgttccgatggttgcccatttaggatcgtaatgacgtcatctaaggagatgtcaaccatgttttggacggcgatgttagtgaaaaaggcgatgtgcggggtcaaaatcacgttgtccatggcgtggagctcctcaactagtggctcacccttcaggccgtcctggcggtggtcggcgttaaagattggcccttcaccctccacggtgtccagggcggcaaaggcgagcggaccgtcctttaaggcgttaattaggtcggcggtgttgacgaccggtccccggctggcgttgactaggctagcgcccggcttcatttggtcaaactcggccttggttaagagaccctcagaagttgggttcaaatccacgtggagggaaacgacgtcactttgccggaggagttcctctttagaaacatattcgacaatcccttccatttcctcgcggggcttgaggtcgtaaccgagcacgcgggcgtttagggcgtgtaagagggtggcgagggtccccccaattcggccgaccccgatgatgccgactgttaccgagtggatttccttggcttgcagtcccggccaacggtagtcgttttcagcgacccggcggtcaacctcgggggtcttacgtaagaggcggaaaatctgcatcagggcgtgttcagccaccgagcggggggagtaggcgggcacgttggtcaccttcaggccattttgcttggcagccgcgaggtccaccatgtcgtagccggccgttcgggtggcgatttgcttgagcccgttggccttgagggtcgggtagacttccttgcccagtgggttgcgctgttggatgaccaccccgtctacgtctgcggttagctctagtacctcttcgatgggctgggggctagtaacgatctcaacttggtttctagtggcgtagtcttggatggcggcttgttcgtcgtcacgaacgctggtcattaaaatcttagtcatcttggtctctcctttttagtggctggcgacaaagtcttggatacggctggcggcgagcttcaggttgtccatgctggtggcgtatgagaggcgcaggtagccttcaccaccggggccgaagaaggaaccggggatgacggcgaccgccccttccttagcgagggcggtggcaaaggcctcgtcgtcttggccaaacttagttggtagcttagcgaagaggtaaaaggcgccgttggggctggcaaccttaaaaccggcttggcttaaagcttggagcatgaagtcacgccgttcttggtaggcttgtttcatggttaaagtagcctggcgcccctcttcagaaccgaaggccggcacggcggcggccatggccgggttggacggggaggttactagcattgagtgcaccatcgaaacgaccttcattagctccgccggcccggccacgaagccgattcggtaaccggtcatggcgtgagacttggaggccccgtttaagaccagggtttggcccggtaggtaggtggcaatggaggcgtggtgaccgctgtaaatcaattcggagtagatttcatcggcgatcacgaagaggtcggtcggttcgataaccgccgctaggtcctggagttgtgcggcgtcgtaagtgaccccggttggattggacgggtagtttaagagcagggctttgaccggcccctcttttacgagcgtctcctctaacagggccggggtgaggacgaagtcggtggcgctggtgtcaaccaggaccggggtggcaccgagcatttggaccaccgtctcgtaaagcgggaaggtcggggtcgggatgatgaccttgtcaccggggtttaaaagcgcctcgaagctggcgaagatcgcctcggtcgccccgaccgtgaccgcaatttcggtggcggggtcgtaagttaggtcgtagcgatcggaaaggaagtgggcgattgcctcgcgcaacaccgccgttcccacgctgggtgtgtagtgggagtcgttaccttcaattgcctgaatggcggcgtttttgagggcggtcggaacgttgaagtccggctcccccaaggtcagtttgacaattcctttgattgacgagacttccgcgtcaaaggtccggatgttggaaggggcgatgctggttaaatcatgattaaagcgaccacggagggctgggttcatcttcggcatgggtaagacttcctttctgaagacggggaaacaaaaagcgcccgggaaaactcccgggcgctttgttcccatttgacgggtcaccgcgcgtggtttccgggagtgcttcctagaaaccaccacaacgaaagctggttcctaggccgaagcgaaaaagaaccaagccagataagcgtttcgttgtgtcgtggctgagcgcattggtgaacccccttgttaaaataagttacccatattctaatctttctctaatcaaagtcaagaaaaacttttgggaaaaatatgtgtttcacacttgtgttatatcgcgaaagtggtatactaagaatcgtaaaggaagtgaggaccatgcggatcgatatcaaggcttacctcgataataaccacctgaccatttaccgggtggctaaagattccggatacggctacaccactttacacaagtcgtttaacaagcagcaaaccaacgctacttcgctcaacttgcgcgacctggacgcgattgcccaggcccagcataagcagatgtggcaggtcctccgggaattggaggagcagtatttattcgacgatgattagaatatgtgtagtctcagggtcggtgtttaacggtgtttaacatgggcccttttctacacgctcactttaaatgacaatcaagggggattgcattatggcacgaattccagtagatccatttaacaacgatatggacgacttatttaaccaactcatggggggaatgaacgggttcaacagcgaaaaccgccgttacctgattaacgggcgcgaagtaacgcctgaagagtacgccgcctttcgccagaccgggaagctcccgggtgtaactgacccaacccaagtaaaaactaagcaaccacaaccagacagcatgctagctaagctcggccgcaacttgacgcaagaagccaaggacggcaagctcgacccggtgatcggccgtaacaaggagattcaagaaaccgccgagattctgtcacggcggaccaagaacaacccagtgttagtcggtgacgccggggtcggtaagacggcggtggtggagggcctagcccaagccatcgtggccggcgacgttcccgctgccatcaagaacaagcagattatttcgattgacatttccagcttggaggccgggacccaataccggggctcctttgaagagaacatgcaaaagctgatcgacgaggtcaaaaaggccggcaacgtgatcctcttcttcgatgaaattcaccaaatcatcggggccggaaacgccggcgacgcctcgggttccaagggaatggctgacatcttaaagccggccctttcccgcggcgaagtgaccttaatcggggccaccacccaagacgagtaccgcaacacgatcttaaaggacgccgctttatcccggcggttcaaccaagtaacggttaacgccccgagcaaggaagacaccttcaagatcctgcaaggtttacgtaagctgtacgaaaagcaccacaacgtttccttacctgacgacgtcttaaaggccgccatcgattactcggttcaatacattccgcaacgctccttacctgacaaggcgatcgacctgattgacgtcacggccgctcacctagcttccaagcacccggtcaaggacgccaagacgattgaagaggagatcaaaaagaccgaggccaagcaacaagaagcggttgaaaaagaggattaccaagccgcccaagaggccaaggaccaggtggccaagttgcaagaccaactcaaggaccactccgaatccgaacgggtcgtggcaacgccgagtgacgtggccgccgccgttgaacggatgaccgggatcccggtgtccaagatgggtgcttccgatatcgaacgcttaaagggcttagccacccgtttggaaggcaaggttatcggccaacaagaggccgtcgaagccgttagccgggcgatccggcgtaaccgggccggctttgatgaaggtaaccggccaattgggagcttccttttcgtcggcccaaccggggtcggtaagaccgaattggctaagcaactagccctcgatatgtttggttccaccaacgacatcatccggcttgatatgtccgaatacaccgaccggacggcggtttccaagttgatcgggaccaccgctggctacgtgggttacgacgataactccaacaccctgaccgaaaaggtacggcgtcacccgtacttgatcgtcttgctcgacgaaatcgaaaaggccaacccgcaagtcatcaccttgctcttgcaagtcttagatgatgggcgcctaaccgatgggcaagggaacacggtggacttcaagaacaccatcatcatcgccacctctaacgccggcttcagtagcgacgccgtggcgggcgaggacgctaagttgatggacaagttgcaaccgtacttccggccagaattcctgaaccggtttaacgcaatcgtggaattccacgccctgaccaaggacgacttaaagcaaatcgtcgacctgatgttagccggggttaacgaaaccttggccaagaaggggatggacgtcacggtgaccgatgaagtgaagaactacctgattgacaagggctatgacaagacgatgggggcccggccactgcggcgggtggtggaacaagagatccgtgacaaggtgacggattactacctcgaccacctggacgaaaagcacctcgtggccaccttaaaggacggccaagtcgtgattgaacaagcaaagtaagtgcggatcaaccttctcgacaggccgttgggctaagctaggacgggggttgatacggcacgcatcgttctccgaccgtacttagccactaggcctgtggttgggagcacgttaaaagtaagtgcggaccaaccatttggcaggccgtgggctaaggctaggcctaacatttgaatagctgtaaaaagagactggaaaaagttttccagcctctttttttggtcagtgaagtgaatttcttggttctccgggtccactacgttaaaataaagatattcataacgtttgggggtgttggtgatgggtttaacgtgggacctgattaggtgggcgcttttggtgatcgtgatcatcaacgaagtggcggccctggtgaccgttttccgggaaaaacgggacatcgccgctacttgggcctggctaatggtgctaatgattccggtgatcggctttatcatttacgcctttttgggccggaaattaccccaaaaacgcctggaacggattagttcgccaaccgcccaacacctatacgacgcctttgaagaacagcggaccgcctttgtggagatgccccaccccgaggacagcctggtgcaaacctaccggcgaacgatcatgctctttcaaagcattgatgagtcctttttgagcgaggacaaccaggtggaaatcttcaccaccgggattaccttttttaaccggttactaaccgatattgagcaagccaaacaaagcatccacattgagttttacaccatctacaacgaccaaattggcaaccgcctgcggaccctcttggaacaaaaggcggccgcgggtgtagaggtgcgggtgctgtacgattcttggggctcaatgggggtgaagaagagcttttacgataacctacgtaaaaacggcggctttgccagtccctttttgatgacccactctaatttcttagactttcggttaaactaccgcaaccaccgtaagatcgtcgtcattgatggccagattggttacgtggggggctttaacgtcggtgatcagtacctaggccggctaaagaaattcggcccgtggcgcgacacccacctaaggattcaagggggcggggtttacagcctccagcagcacttcttgcgtgactggaacgcctcggtcaagccggccgagcgcttgacccattttaaggactactttccttcggccgccctcaacaagggaaaaacggcgatgcagattgtctcgtcggggccggatgcccccctgcaggccatcaagctcggctacttgcgcctaatcaacgccgcccaggaccatatttggatccagacgccctacctgattcccgatgattcggtgatcgacgccctacggattgccgcccactccggggtggacgtccggatcatgatcccttcgatgcccgaccacgcctttgtttaccgggccacccagtattacgcccgcgccctagccaacgaaggggtgacgatttattcttaccaggtgggcttcttgcacgccaagacaatgacgatcgacggcaagatggcggcggtggggtcggccaacctcgacttccggtcctttcagctcaactttgagatcaacgccttcttgtacgaccggcagttagttgatgagctagaacaaatcttcattaacgacgtccgtgacagccgggtgattaccccggagatgtttgatgcccaaccactgggcctacgttttaagcagaccttctcgcggttgttgtcgccgattttatagggaagtgcgacccaaccattaaagcaggccgtgggctaaggaaagaccacaggttagcgcgccagcggtgttctgtggtcagacttagccactaggttggataactaaaaatgcctccctgtttcggggaggcattttttaggtaaccacgcggtttagcacctatgaggagcaaactcataatagaaagattgagagatttgaaaattgacgcactaaaccgccgagatggatttacttagcacttaataagttcactaagtaacaatttcatttaaccatggtctgtctaaaaaaacaaggaaaaaacttggtaagtgagcaacttaaacgatattaagatgaaaagatagtacgaggtgaatgtgattgaatataaattcacaatcggtcgtccgcacaacaatacgaacattcattcccctttttggcaccctagcgtggtataattaggcaacgatctgaatgggggaatgataaaaatggcgaccttacaatttgttttggggagtgcgtcctttgaccaccagcaagtgatgctcgatcgcttggcggctcagtaccagcaagcacccaatgatacctacctttacttagtgcccaaccacgttaagttcaccaccgaagtagccgttttaaaggggcttaaaaagcggttgaagcaaaccggtaattacgcccaggctaacgtggcggtcctgtccttttcgcgcttggggtggtttttgtgtaaggacgaccccgattaccaaaagcccctcctttccaacgtggggatggcgatggtggtcgccaagatcattcgggaactcaaggcagaatcccccgaccttttgaagatgtttcggggcgaaagcgaacgccagggctttgccacggcggtgaccaagcagctggtggaactacaaaacgccaatattcaaccggccgacctggcgcccgatcaggaaaccgggattattaagcgggccctggctagtcaggcggggggtggccgggccagtcaatcgacggtctttaccgacaagatgaccgtcctgtacgaaatttaccggcgctttgaggcggcggtcacgacccacgtcacggcgccggaccggtcagcgatgctcttaaaccacctcgaagccgccgacctatcaacgacccacgtttaccttgatcgctttgccggtgaatttagcgcccaggaacagttgattgtcgacgccctgattcaacgggctgccgacaccacggtttctttgatcctcgaccgggattaccggggacgggagttgccgagtcaaaacaacctctattaccgctcggccaagcagtaccaggacttattgaacctcgccactcagcaggtgggcgtggatgtgttagacccgattgttttgaatcagccgaaccaacgacgggttagcgacgccttggtgggggtcgaagagtggatggaagcagacgcccgcttcgctctgccagacaggttgccggccccgaccgaccaagtaggctttttcaccgccccaacccgggtggccgaactcaaccgggtcgccaccaaaattcgccagctcgttgccaccggtcagtaccgctaccgggactttttagtggttacgaggcacctggacggctaccaaacgatgctagaaccgatctttagccgccaccaaattccggtcttcaacgataaccaacgcccaatggcgacctcgccgctagcgaccttcaccgccgccttgttcaaggtcttaaaggactactaccaagaagccgacgtgatggagttgttaaagaccggcctcttggttcccgagacgccggaagagctccaacaggaggggcgtgcgaagcgaaaccccaacaccttcatgaccgccgtctaccggaccgaaaactactgcctgaagttcggcaagggggggcggtcgtggtttgacgagcggccgtggcgactggaaggagaacaaccagaaagcgatgcgctcaagcgccaaaacgctcagattaactgggtcaaaaattacatcaaagacgaattggccccggccctggccgacctacaaacggccactaccgggcgggagttagccaccaagttctaccagttcctcttggatcaaggggtccgtcaccaactttattcctgggcccaccaagcccaagaaagcgggcagttaacccagctgcgcgacgttcagcaaatttggcagacctttggcaccctcttggacgagtacgtaaccatccttggcgaccaggtggccccgaccgagcagccgggacagttggtggccgagtttgccgacctcatgaacgccggttttaacgccgggcgctacgcccaaatcccgtcgactttggatcaagtgttggtttcggaaagcgggatgatccaggacaaccagcgcaaggtcctcttcatcatgggggcgaccgatgacgtgatgccggaagtcaaggccagcgaggggctcttatccgaccccgaccgggaacttttgaagcggggcttaaacgacgaccagttcctgcccatcagcgggaccgaccagatcaataacgagcccttcttaaactacctgagcatgctgtcggtaaccgagcgcctctacatgagcgcccccctgatgagcagcgacgacagtgagttaaccctctccccgtacctgaagggcttggcccgtcacttcaaccagtgggatgaccaaaacaacgccccgaccaccgacttgccagaccggccgaacccgcgggcaagcgaagacgacgtgtggtcctttgtggcggcgccggccgtgacgatggggaacctgattgaagtggagcgcctgagtaaggacaccggccgtaagctgactagtgcctggcgggacgtggccagggcactaacccgccacgacgagggtttgacggggcggttaaacgacatccgggatggccagtacgccaaaaacgaggcggtgccactgcaaccggaactggcggcccgcttgtacaccactaaccgccagggccaagtcaccaaccagttgacggcttcgattagccagctggagaagttctaccaaaacccgtacgactacttcttgcgttacggtttgcacctgaagaagcgcgacgaattagaggtctccagcgacaagtccgggaccttaaaccacgacgccctggccttctttgtccaaagcgtgatcgacgaaccggacctgcagctggccgacttggttaaagaagagcaccaagggcgccaagccgagttgattgaccaagcctttgagcaggccatgaaccaacaagaggagttgcgggaattggcggccaataacagccgggtcaacttgcaactacaggtggccaagcagttgattaccaccatggccaagaccctgtgcctgcaagcaacccagaccgacgcccaaccagtggcggttgaaaaggcctttgggcaggcggattggaccggggaaagccaagccgccgagttaccagcgttaacctttgacctgaccggggcggggctcggtgagggcgccaaggtcagcctgcgggggcggattgaccgcttagacgagttgaaactgggcgagcaaacctaccagctggtggttgattacaagtcctacaacaaggcgtttgacttggtcgacgcctacgccggccaggccctgcaaatgctggcctacctcaacgcgttacaggcggccaacccgggcgagcaactactggggagcctgtacctgcgtttgtacgtcccgaccgttgacgccggcaaggaggggaccgccgaggagctaaaagagcacctctaccaggggatcacgattaacgatgacgccgtcttggccgccctcgatcacgggcttggtgaaaagggtgccaccctgttaagcatcaaaaagaagagtaaaaaagacaccagccgctttaaggttagtgccgacgatcaattcagcgctaaggcgggctccaacctggtctcaccaaccgatttgaagcgcctgatggaccacaacgccgaactgattaaggaagccgccgttcagatcctgcagggccaaaacgagattaggccgtaccggcgccaagtcggcaccaccgcggagaccggcctggcctttagcgacttcttagacgtttcccgcttcgatcaggccctggatgactacaaggaaatcgagctgaccgacgccgacgtggaagcaaagtttgaacaagaggaggaataggggaagatggttttcacaccaagtaaggaacaggagccggcgatcaacgaccggcaaaaagacattttggtttccgcctcggcggggagtgggaagaccgccgttttggttgagcgggtgatccagctgatggaaaccggactgagtaaggacgctaagcctagcgagcggcccaacatcgatgacatcctgatggtgacctttaccaccgacgccgctaagaacatgcgcgaccggatccgccggcgcctggtcggggcgaccgacgaacacatgaaggcccaggtggcccgcttggccctggccaacatcagcacgatccactccttttgcgagcagttgattaagcgctactactacgtcatcgacctcgacccccagtttcggttaattgacgacgccgaacagcagctcctaaaggaacaggcctggcaagtgaccctcgatgactgggtggccaatccggaccaagtgggggcgctgcaccagttaatcgataactttggggcggggaacctcgagtccgtcgttcaggcgctggacaccgaggccgacgcccagccgcacccaagcgactggctggccggcttaagtggcctttaccagttcgaagaaggggcggacccgcggcaaagtgccttctttaagcgcctcttggaacccctcgtgggcccgcaactaaaggaactgcgggaccagtgggcggcccttggcgaagtggggccggcccgttttgccgagcaggttgaagaagatttagctaaattagccacgaccgttgatgaccagggccatttgttaggcagctgggacagcctggcccagaccctcaacaagaagaattttgcgcctaagttgcgcaaacgtaaggatgacgacgatcccgaactcttagacgaactgggggttcagcggggtggcctgcgggatcagctgggcgacctccacgatacctacttcttccagtccgccgcggacctggttaagtatggtcaaaaggctggcgccctaattgagatcttaacccgggtggccaccgacttccggtgccactaccagatcatcaagcaggaccgccgcctgctcgatttctccgacttagagcactatgcctacgccatcttgaccggcgaaaacatcaacccaaaggtgacctggagtgacgaagaagagcgggccaagcgccaagccgccgcccaagtccaagccgagttgcagcgccactacaaggaaatcatgatcgacgagtaccaagacaccaaccgcctgcaagacgacctgttacgcctcttgcacaagagtgggcaaaaccaccgctttatggttggggacatgaagcagtcgatctaccgcttccgccaggccgaccccaccctgtttaaggactactacgatcagttcagcacggatgggcaaagcagtgaggccctggacctgagcgacaattaccgctcccgccacgaggttaccgacctggtcaacctcattttcgaacagctgatggaccagcaattaggtgagatggtctacgatgataaggccagcttgaagcccaaggccgattggggggccgaccgggaccaggctagcccggcgaccccggaaatcctgctctttgatgggggcgtcaagaaaacgaccgctaaccccaccggcgaggacgccatcgtggtccgccagccggaagacaaggtcgctagcgaagtctggctgattggccaacggatccgcgagctcctggccaaggaaacgatcttggacccggaaaccaagcgggtccgcccgatcacgccgggcgacatcgccattttgtcgcgggccaagcggattcactcggtgatcgccgaacagtttgccaagcttaacttaccggtgatggtgcacggggtggaaaactactttaaggccaccgagatccgggtcgtgatgtccttgctaaaggtgatcgataacccctaccaagacgttccgttggcggccgtgctccgttcgccgctgattcaagtcgctcccgaggtggcggctaagttcggcctgagccagggcgaaaaccggatcggctttacggaaccggagttagcctacttgaaggtcaacagcacctccaaggacttctttggcgtcgtgcagcaaaactactacgcttggcgcgatcaagaggtcgaagcggttgaaaaccacgacgccctgactgaagaggagctcgccgaacgggtcgcaggcgacccggccggcttagcgactaaggaagaactgggcgtcaactgtgggttaatctacctgaagttagcccgcttctttgagttgcgggaccacttacgccgggtcgcccagcgacgccccctggtggacttgatctggacgatttaccaagcaaccggctacctggattacgtgggcggaatgagcggcggcccccagcgccaagctaacctccacgccctgtacgaacgggcgagtggctacgaggagagtggcttcaagggactttaccagttcatccacttcatcgagcagatgcaaaagaaaaacgacgacttgggcgaggcgaccacggccctggccggtgacgcgattaacgtcatgacgatccacaagtccaaggggctccagttcccgatcgtcttcttagtggaaacgacccaccagttccaagccgaccgggatccggtaacgattgagccccaggccggtcttggcttcacctacgtggatagcacggccaacgagacgatgcgcgtcaagcacccgctggtccaacaggcggccttaaaggagaaaaagaagcgccaggaccgggccgaagaaatgcgcctcctctacgtggccctgacccgggccgagcagcgcctcttcatcaccgggtacgtgaaggacgctgacctgaccaagaagatggataagtggaaccgggcctttgatagcgccagcccgctgttgaccaccaccacacgcttgaaggggcaatcgatgcttgattggatcatgatgaccctagtgcggacggcgaacttcccaacgctaagggagggggttgaagtcgccgccaccccgctgcggggccttaccaaggcggcctaccaaattaagctgcaaaacgctgaccaggttcaggcggccctcaacaccccgctggacctgcacccgaatgcgacggcggagcaagccaccccggcggccgccactagccgccagtttaaggccgacttagaacgggtgttaaactttacctacccggatcaagtggcgacccaaacgaccgcctttcaagccgtttcgacggtgcgggaggcctttgcccgccaggaccctaccaacctggagatgggtcggctagaaattgaccgcgaccagatcaaagaagccggggcctacctagcaccggaagagcgggccttcgaaaatcccgccttcatcaccggggcgagcgatcaggagccaaccgggacggcgatcgggaccgctacccacttggtcttccagaaattaccgttaacggaaccgcttgacgaaggggcggtccgtgctttaattaagtccctaacggagagtggtttaatcgataatccccaagttgcggcgggcattgacgtggccggcgtggtatccttttaccaaacggggctcggtcaggtcattaccgcccaccctgagcaggttcaccgggaagtaccgttctcgatgttactgagcgcccacgatctcttcagcgggattggggccaccgatgacagtgaggtgttgatccacgggatcatcgacggctacgtccaacacgacgaccagatcgacctgttcgattacaagaccgaccggatcagtcaggcccacccggaagaagacctccaggaactggcggacaagtactcgggccaactggtgctgtacgccgatgccctgaccaagatgacgggagttcccctagaaaagatccaccgccacctttacttcacccgggccaagcgggtggtaaccctgagcgccccgccgtcgtcgcacgaaccaaaggaggaagcataatggaattaaaggacttaacgagtacctacacccttgccaacggaatcgccattccggcggttggttacggaaccttccggaccccggccaccgtggcccggcaagcggtcaaaaccgcgattgaagtcggctaccgtcacatcgacacggccgccgtttacgaaaatgaagaggcggtcggccaagggattaaggattccgggattgaccgcgacagcatctttttgacctctaagctttggaataccgagcggggctacgataagacgatcgccgcctttgaagcctccctcaagcgcctgaaaacgacctacttggacctgtatttgatccactggccggccaaccaaaagcagtttggtgaccaggccgcagcgcttaacgccgagacctggcgggcgctagaagacctctacaagcagcgcaaggttaaggcgatcgggctgtctaacttcatgccccaccacgttgccgagctgttaaagaccgccaagatccgcccgcaggttgaccaaattgaggttcaccccggctggacccaccaagaagagattaagaagctccaagcgatgggaatcttggttgaggcctgggccccgttgggtggtcagggagccacggtaatggagaatgaaacgatcaagcaaattgctacggcgcacggtaagaccccggcccaagtggttttgcgttgggagatacaacaagaagtcctgccgctaccaaagtcggttcacgaacaccggatgagggaaaacgcggacgtctttgacttcaccctgtcaccggcggaaatgggcaaaattgccgctttaccgaacatgggcggccagtgcgccgacccggatgaggttgactattaaggagtgcgctccagcctatcaagcaggccgtgggctaaggataggttacaggttagtgcaccagcggttattgaccacgttggctgcctaacattcagaaagataataagcgcccgggagaaaatcgtgttttctcctaggcgcttttttatgctcccccaatcgatgccccccgctacggccgcctttttttgggggtggtacaatgggggacagtaagtagaaaaggaagaaaagatgcaagccctgaaattaaacctaatgtccgttcgacgcgttggcctggctgggtttggcttggtcgcctcattagacctggtggcaacttggctactcaccccgccgttacgcctcgtgacgactttcttattggcacaagcggcgatcccctttgtgtccgttgacaacgtcgtcaccctcttgaccacccacccgttaatcgtctgcgcccttctagtcgaggtgtgtgtggtcctggccttactgggtctccaagtcctggtggcctttagcgggctcaggctcttagtggccggacgcttttccttcgccggctggctagcggcctgccgccagcaggtggtgaacttaggctggcggggtgccttggcctgggtgccgctgttgatcgtggcgatgccgattgcgaccctgttgtttcggaccccgttgctggtcaacatcaaggccgacgcctttatcctcgattacctaaccaggcggccaagtttaatgattggcggcgtgttggtttacgcagcctgcttgttcatcgtggtgcgctggctgtcctggggacgggtgaagagggcgctaggcttggccctttggtggggggcgtggtcctggctcgtcaacgggttggtggtgttggttaaccacggcaacgccccgacttggttggcccttagcggactcttaattgcccgggtggcggcggagttggcccttagcgtaaccgccctgggcttggtagccactccccaaaagactgccggtccccaccaacggcgcccctggtggctcttaatcttagtggtgtttgtcttcgccgcgatgccgagcgactggacttacttaacaactaagttagcggcgccgttgacggtcgctcaccgcggtgttgacgggcaaaacggcgtgcccaattcaattgcggtgttaaaaaagacccaccgggcggcccacccagactttgtcgaaatggacgtccacgaaacggccgaccaacagtttgtcgtcgtccacgacgaaaacttgaagcaactgaccggggtcgacaaggcgccccaccagctaacccttaagcaactgacgaagttggtggccaaacaggatggctaccgggccaagctagtgagttttgatgactacctggcggctgccgagcaaaaccaccaacgcctgatcgttgaacttaaggcgaccccgcacgattccaagggcctcttggcgcgttttaaccagcggtacggcgcccgtttgatcaaggatggggacatggttcactcgctcgattacgcttacgtagctaagttgcaccggctcaaccccaagctaacggtgctctactgcatggcttacaactttactaacccggctagggaagcggacggggtgacggcggagtattcgaccttaaaccaccgcttcattgacgccgcccaccaagggaaccaactggtaatggcgtggacggtcaataatgccggggcgatgaagcaggcccttttcgaccacgccgacggggtgatcaccgaccgggtcagcaccctgaataaggtgatcaaagaggtgcggacaaacgatacgctggaaagcaggttggttaactacttcaacccgctgcctaacttagagtgaaggggtaacggatcgtagctcgcgttaactaaacagcccctgaccgatgagttgccattggtcaggggctgtttgattaccgaaggactggacaggataaatgtttagatttacgcaataaaaagtgagtgcggaccaaccattggtaggccgtgggctaaggatagggcgaacggttggtgcgccagcaccgttcttcggccaggcttagccactaggcctgcggttggggagcacgttatcctgcgcaaatttgcagatttgtcctgtcttgcaaaagggtggttaactggttagcgccaggtttgttcgtaaacgtcttctttaaagccgcaggtcagttgcgagccctcgaccatcaacggccgtttgattaacttaccgtccgaagacagcagggtggcggcctcgtcgatcgtcatggttggtagcttatccttgagcttttgttcccggtagtgctggccactggtgttaaagaagtagcgcaggcccaggtcttggtgctcggttaaccacttaacgaagagttccttggccggtggttctgcgaccaggtcttgttggtcataggcgacctggtggtcatcgagccacttttgggccttcttgcaagtcgaacaacgggagtagcagtaaaaagttggcataggggcgttctccttttttttaaactattgtacaccgcttaaaccttgcggtaacgttttaagcccaccacgtttaagaccacgaagaagacgatgaagaggaccaggacgccaaggtcaccggcgatcgtttcaaccccttgccccttcatgatcacgtcgttcatggcgttgccggcgtaggttaatggcaggatttttgagatgacctgaatccagtttggcaaggcgtccaacggcacgatgccggagaaaaagacctggggcatgaccacgatcggcacgaactgcatcatttgaaattccgagctggcaaaggtggagataaagattcccattgctagtgccgccagggccaacaagatgttgattaaaaagaccagggccaagtcaccgacgatttggacctttaggagccagaccgtggtgatgacaattaagagggtttgcacgatcgcgacgaccccgtaagaaaccatgtagccggtgacgatttcgccgcgccggaccggggtggccaggagtcggtcaagggtgccggagctgcgttcgcgcaggaggccgatcccggagatcaagaagacaaagaagaagacgaaaaagcccatgaagattggtaagatcttggtgaagtaaccggtcgaagaatcaccgtagcggtaggtcgacttgatgtgggtcgtggcgcttgcggtcccctggttgaattgatcctgcgccgtcgttggcaacatcgccaccagtcgctgtatggtggccgccagttggtgggcattgctcttttgcagggcgacttggaaggcttgcttggtcaaagcggtcttggccgagtcgatgttggcaaaggttaggtggtagtgattggcgctggttttgaccacggtggcgtcgatgcggtagtccttgagggctcggtcggcctggtcagcgctggcgtaagtcttgaccgagacgtgcttgacgacgtcgatttgcttgactaacgacggggaaaggttggccgtcccgatcgttacgtgggtatcagtggtggctgaaaacataatcgataggagccacatggttaaaatgggggcgataaagagcagggccagggtacgtttgtcgcggatcaattcggttaagatccgtttggtgatggctaaactacgcatgtgcgttcacctcccgttcggcctttaagaagacctcttcaattgagccaacgccgtaggattgcttgagggcggccggggcgtcgttggcgatgatccgaccatccatcaagagggccaccgaatcggtcatctcggcttcgctcatcacgtgggtggttaccagcaccccgcagccatcctttttcaaccggtccagttcccgccagatttcgaggcgcagggccgggtcgatcccgacggtcggttcgtctaaaattaagagctggggttggccgagcagggcgatggccaatgacaggcgccgtttcatcccgccggaaaagccgctgacccgcttggttaagtcgttgcttaggtcgaccaccttggcgacgcgctggcattccgccgttaattgatgacgttcaacgcccttcagttgggcaaaaaaggccaggttttctttggcggttagggtctcgtataaggcgtcactttgggccatgtagccaatttggccgaggatctgacggttaggcatttgttggcccaggactagggacgtgccgctgtcggctttttccattcctaaggtggtcttaatcaaagtggtcttgccggcccccgatggcccgatcaggccgatgattttttccgaggtaatggtgaggtcgacgccgtttaaaacggtctgggcgccgaactgtttatttaaagccgtaatggtgattagttcgttcattaaaggtccccccttgcgtttgattaactttattatggcttgccaaggcgggggcaacaagtcacaataatcttaacgttgtaattaaaagtgacacctgtcgcttttgctgacacttaacgaaaagtggggatcaagatggtaacccaagctgccaaacggatgcaaaaaacgattgaagaagcgtacttagacctgttggaaaaggagagttttcgggcggtgacggttacgcaaatcgcccaggcggcactgattaaccgccagaccttttaccaccactaccaagataagtacgatttgaccgaccggatgaccgcggcggtttttataagggtgcgtgaactgattgacgttcgcttggcccagctcaagcgcggggagtcagtcgatgacttctttagctttttaaatttatcagccacccagcgcttcttgaccccggccctgcgccggcgggtgacggctttgtacacgatccaatacgatcaactaagcctgtcgcagcgaattcacgactacgtggcggcaaacctgcaagacctgctggcccccggggcccccgagctagtcagtgacctgttggcgacgctgcttactcaggtcttgcggaccatttttgaacggggggaattcccaacccccgccgaaatccgggcgctcaaggccgcctttgcccgtttactcaactaaaaagggtggtcaacattcaaaaatacagcaagaggccggaagaaaacgtggttttctcccggcctctcgtgggttaaggactagtagtccccgtttaaaattgagtttttaacgataacgtagtcgaccttggtgatcgattccaggtcgcgcccaccggcgtaagaaatcgctgactggaggtcttcttccatctccaccagggtgtcttcgatggcaccccggaacggcaccagcatttgcttaccttcgacgttgcggtaggcgcccttttggacttcggaggccgagccccagtattgcttgtagcgcttgccgtcaatcgtgatcaggttgcccggggattcttggtggccggccaacagcgagccaatcatcaccattgaggccccgaagcgaacggacttggcgatgtcgccgttgtggcggattcccccgtcggcgattaatggcttgcgggcggccttggaacacaggcgcagggcggcgagttgccagcccccggtcccgaaaccggtcttgagcttggtgatgcaagccttaccggggcccactccgaccttggtggcgtcggcgccggcgttttccaggtcgcgaacggcctccggggtggctacgttaccggcggttaagaaggtggccggcagttgttgcttgatgtgtttaatcatggcgatcacgaaatcagaatgtccatgggcaacgtcgatcgtgatgtactccggcaccgattgttcgttttttagttgattgataaagtcatactcgctgtccttgatcccgacggaaatcgaggcaaacagcccccggtcgtgcattcgcttaacgaagccggctcggtccgcggggttgaaacggtgcatgacgtagtagtagtcattttgggctaaccagaccgccaattcttcgttgattaccgaggccatgttagccggtacaacgggaatcttgaaggttttgggaccaaatttaacctgcgggtcagcttcctttctgctcttgatcacacacttgttagggatcagttgaatgtcatcataatcaaaagtttccatcgggatacctcgcttaaaaagtgatttgaaaccgttagtaactataggcgaaaataagggcgccgtcaaggataaaaccgaacaattttacctaatgtcaggaaaaaggttcagaacagcccttgcaaatcacgaactgatccggtagtatcatagagtaactgtgcttaattttaagactaatgaggtgaacagaatggcaacagtagtaatcgtaggaagccaatggggagacgaaggaaaggggaagatgaccgactacctgagtcaagaagcgaacgttgttgtccgctcccaagggggggacaacgccgggcacacgattgaattcgaccggcaaaagtttgccctgcggctgattccgtccgggatcttcggtgaaaacaccaccgccgtgattggtaacggggttgtcattaacccgcaggccctgttggaagaaatcaagtacctgaccgaccgcggggtcgacatctctgggctcaagatttccagccgggcccaagtgatcatgccataccacctcttgctcgatgaatgccaagaaaaggctaagggcgccgctaagatcgggaccaccaagaaggggattgggccaacctacgtcgataaggtttcccggatcgggattcgggtggccgacctcttggaaaaggacacctttgcggcgaagctcaagcaaaacctggagattaaaaaccagctctttaccaagatctacggggtcgacccggttgattttgatgaaatctttaaccaatactacgaatacggccaacaaatcaagcaatacgtcaccgatacttcgctactggttaacgacgccatcgaccgcggcgacaaggttctgtttgaaggggctcaggggacgatgttagacatcgatgaagggacctacccatacgttacttcctctaacccaacggccggtggggcgccaaccggggccggggttgggccaaacaagattgagaccgtggtcggaattgccaaggcctacacaacccgggtcggggaaggaccgttcccaaccgaattgaacgatgaaatcggcgactacatccgcgaaaccggtcacgaatacggcaccgtgaccggccgtccacggcgggttggctggtttgacgccgtggccatgcgtcacgcccgccgggttaacgggatgacctacttgagtttgaacctgctcgatgttttgaccggcttgaagacgatcaagatcgcccgggcttacgaactcgacggtcaagaaattaattactacccggctagtttggcagaattagaccggtgcaccccgctttacgaagaggtgccgggctgggaagaagacatcacccaagtgaccgactacgaagacctgccggccaacgctaagcacttcttggaccggatcgtcgaactatcagagacgccactggccacgatttccgttggtccatcgcgggaacaaacgatcatcctccgcgacccgtggcggggttaaagtaaactaactgacaaaagagcgctaactgtctacttagacggtgggcgtttttttgttggctgcataaattggcagacggctagaccgtttgtgattttatcttatctgacgataaaattattgttgatccactagcggtgtttataaaattagtttgtgaaatttatggcagtgacgataaatttcacaagttaagttaagtggtacatagcttgttaaatgttacttaatgaacaggagttaaaaatacttgtgaaatttaaaaaagcggttacaatgtgaagtgcagataataaccaactaattattagggaggcctactcatggcatatcaaactgttaatccttataccaatgaagttgaacatacttacgcagataccactccagaagaagtggagaaggcgttaagcctggcgcacggtctgtacttaaagtggcacgacggctctggtctggaagaacggaaagctgtgattacaaagctggggacgctccttcgcgaacgccgcacggaaatggctgaactgatgacccgtgacatggggaagttaatcggtgaagccgaaggtgaagttgacctttgtgcaagcttttgtgactactacgtagaacacgccaacgaattcctggcaccaaagccaatctacaccacttccgggaacgcctttatcttaaagcaatccctcggggtactgatggcggttgaaccatggaacttcccgttctaccaaatcgcccgggtctttatcccgaacttcatcgtcgggaacccgatgctgttaaaggacgctgctaactgcccaacctcggcccaagcctttgctgacttggtactggaagccggcgccccagaaggttctttgaccaacctctttgttagctacgaccaagtttccgaaatcatcgctgacccacgggttgccggggcctgcctgactggttccgaacgtggtggtcgttccgtggccacggaagccgctaagtcgctgaagaagagcaccctggaactgggtgggaacgacgccttcgttgttttggaagacgccgacatggacaagctggccgaaatcctgccgcaaacccgtctgtacaacgctgggcaagtatgtacttcctccaagcgttacatcgttccggaaaagctggttccgcaatttgtgaacatcttaaaggacggcttctctaaggttaagatgggcgacccgttggaccgctccacgactttggctccgctttcctcgaagaaggccaaggaaaagctgacccaacaagttcaactggctatcgacaacggggctaagctcgaatacggctttgaaccagtggaagaccaagagggtcaattcttcatgccaaccatcctgaccggggtaacggtggaaaacccaatctttgaccaagaaatgttcggcccagtcgccgttatctacccgtacaagaccgaagaagaagccattgaaattgctaacaactctagctacggccttgggaacaccgtctttggtaccaacattgcccacgcccgtgaagtggcttccaagatcgaagccggcatgagctggatcaacgctggttgggcctccctgcctgaactcccattcggtggggttaagcactccggttacggtcgtgaattaagtgaaattggtttcaatgaattcgttaaccaacacctgatttacgaagtagaaccaaccgcttagtctttacctccctctcctcttaaatttatcggtgaaaatccccgtcaattccccagggacggggattttttgttgccaattttccaatttaaagttgggggagtcagaaaaaggttgagaagggcggccgagtgttgacagggtgccccgccccggttaagataggaataataagtaatgcctttaagtggatcccgtgaggtcacaaggacggagaaattggttagcgccgccttggggactctggggggcgcttttgttatcagaaaaaggagtgttgatcgtggcccacgaaattgtggatggttcaagtatgcagcgtgccctaacccggattacctacgaaattattgagcaaaacaagggggtcgacaacctagtctttgtcggcattaagacccgcggcgtgtacttggcccagcgcctggccaagcggatggaacaactggaaggggtaaaggtccccgttggttccttagatattaccctctaccgtgacgaccgccaccaaccggaccaccacgttgagcccacggtcaacgccaccgacgtcgacgtcgatatcaacgataagcacgtgatcctagttgacgacgttttgtacaccgggcggacggtccgggcggccttggatgccttaatggaccttggccggccgaagcgaatctctttggcggtcctggttgaccgtggtcaccgggaactgccgattcgccctgacttcgtggggaaaaacatcccgacgtccaatagcgaaacggttcacgtggcggtcgaagaatacgatggtcacgaagacatttcactggaaaaccgtaaataaaatcaccatttaagtaactccagcgagggtgcaagggtgaagtgggccgttagtgcggtgcctttttcatggcttctcccttcctgggggaagcctttttgtttaggaggaaaaagaaatgcaacgttttgaacccatggtcgccgtcgacgttgagaccaagcaagaggccctgcgcctgtttgacaagttatctagcgacaccgatcaccaaccaatcgttaaaatcgggatggaactgtactacgcctttggtcccgggatcgtccgcgaagccaagggccggggcttgaccgtctttttagacctgaagctttacgacatccctaacaccgtggaacggacgatgcgggtgcttggggccctgggcgctagctttgtgaccacccacgccgccggggggaccgaaatgatgaaggctgccaagcgcgggctcttggctggggcagcggcggcgggccggcgccagcccaagctgttggccgtcactaagttgacctcgattgacgaacagatcctccacgacgaacaaaaggtggccgggaccctgattgaggcggtgcaaaacgccgcccacctgacggaagcggccggcttggacggggtgatttgctcggcccaagaagtcgaagcgatccgccaggtaaccgggccggacttcttatgcgttacgccggggatccggttgaacctggataacaaggacgaccaaaagcgggtggtcacccccgcccaggcccgggaactggggagtaacgcgattgtggtcggccggccgatcaccttagccaaggacccgatgaaggcctataatgaaattcgccaagactttatgggggaacaagactaatggagtttgaacaaaccgttgcaaacgacttgctgagaattaaggccgtcaccctgcgccccgaccaccctttcacctgggccagcggcatcaaggcgccgatttacaccgataaccggctgacgatttcctacccggacgtgcgccaacacatttaccaagggatgagtgacctgattcgccgtttttacggtgaggcgacggtgatcgccgggaccgccacggccgggattccccacgccgcttgggtggccgaagaattgggcttaccgatgatttacgtccgctccaagcccaaggaccacggtcagggccgccaaatcgaaggggtcttggcaccggacgccaaggtcgtggtgatcgacgacctgctgagcaccgggggttcggtactcaacgccgttaaagcggtccaaaaagagggggctgaagtccttggcgtggtggcagacttctcctaccagttaccggctttagacgagaactttgcggccgccaacctgacctaccacacggttaccaactacacgaccctgatcgaagtcgccgaacgcaatcacatggtgacttacgcccaaaaggattccctgcacgcctggcgcaaggacccggctaactggggttaataactaaggtgcattaactaccgcttaaaataagctttatccaatgcctttgacggctcgccggtggcgctagccctttctaaggtagtgggtcctaacttgagtcacttgtcctggggcttattattcgtgatcccggtggtaattgtgctcttggcgctcttgggaattcacccgctggtctcaattaccctgctgggacaagttctattgacgagccaagtaacgatcccaaccttggcgattgcgttagccttaaacgtgggtggggcactgtcctacctggtctcaccattcgaaggggcgattgttctaattagcgacctggctgacgtcccgccgacaacggtggcaattaagtataatggttggtttggcctgtggttcttgttgctcagtaccgtggtgatctatttctttaccaattaaaggaaaataaaaaggcttcgcacccgaaaatgcgaagcctttatttattcttggatgttaggtaacgtgctagcccacggcccgtttggaggttggtccgcacttcccataacgtgctccccaaccacgggcctagtgcctaagtacgggcggagaacgatgcgtaccgcatcaacccccgccctagcttagtccaacggcccgtttcggaagttgggtcgcacttcccccataacgtgctccccaaccgcaggcctagtggctaagtccgggcaaagaacaccacctaggcggcaacccccgccctagcttagttcaacggcccgtttggaggttgggtcgcacttcccccataacgtactccccaaccgcagacctagtggctaagtctggtcacagaacaccgctgacgcgctaacctgtgccctatccttagcccacggcctgcttaataggctgggtcgcacttcctattctttaaggtatttattccgaattaacagctcccgcgacgcttgatcagcggggcgccaccctttatcaaagagccgttggaagtacagccggttgtagatcagggtgaaaattaacgaggaccaggggaagcccagtaaccaggggaggttaaagaccaggccgacgagggcaatgttggcagccgtgaccaggatcaaggcaaagttatagtaatccccccgaaacagggccgggagcgggccaaaccaaaaggtggtccaggagatgccaaccttagcgatccggatgtcgccggtatcgttggtgaccttggcgtagttaggtggggtcgggagattttttaaaaagtcttgattattattttggttgccaaatgggttttgcatggcgccctccttgttattcttagaccttaatcttatcataaactcgccgcgggccccaacaatcttccctccactgcaagggggtgggatccatgttagaatgaagccaactgccgttttgcgattaggaaggacgacgaaaatgctatttttctttaatgataatatccaagaaaacaaatccgggattgagcatgcccaaatcaagcggctaaatctctttaaaaaatttaaccagccggccaagattgtgattcgccagtactccaacgaattgcatcacgttaccaacgcggccggaattgacgatgccgacctggtcaacctcttcgattactttcaagaggcccgcttggtcaaggcgaagaaggtgaccttacaagacctaacctttgacccccgctggaagcgccgcgccgacggggttagttacaactactacgatggcgaccggcgggtgatttacgtgcgccgccaccagcgtgacaagcacgtgatgaacgttcaatactttgaccgcttcggcaagttggttaaggtcagttggtacgacaaccggggctttttgtcggtggaccagctctatgactggagcaaccagatcacggtccaaaactacttcaccccgacccaccggctggcgatgacggccaccaccaccttagataagcggcaaaaggaaacgaccgtctaccacctttacgattaccaaggccaagaccttcagtttgcgaactttgacgagctgacccgcttcttttacgaccagatcgcaaacgaccgggagctgaccggaccgggtccagtcggctgcatcgtcgaccgctcctacgaactgggctgggcggttttgaacatgaaaacccgcatcttccgggtcctccagttgcataacgaccacgtcaataacccggccgacatgcttcactcgccgttaaactacaactacgattggggcttgcgccacttgagtgagtgggacggggtgatcgccctgacgccgtcgcaacaagttgacgtcaccgaccgcttcggtaaggtcgccaagaaggtttaccgggtgccgggggcgattgtgcccgatgaacgcctggccgccaagcacattccgatgaaaaagcgccaccgccatgaggtaatcgtgatcgcccgcctgtcgccggaaaagcaacaggaccaccttttagaggtctggccacagattctaaaggcggtgcccgacgcccagttaaacctgtggggttattccaacgacaacttcgaccaaaagctcaagcagatggttaaagacgagcacttggaaaagtcggttcacttccgcggttacacgaccgacgtgggtaaggttaacgacgaggcccaactaatggtgctgccgtccagcgccgagggcttgccgctgtccttagttgagggccaatcgcacgggctgccaatcgtggctaacgacattaaatacgggccgcgcgacatcatcgttgacggccagaacgggatcttaacccaaaacggcgataaagcggggctggccgcggcgatcatcgacctcttagaagatgatgacaagcgccaacggttcagcgaccaggcctaccaggacagcgagcgctattcggaggccaacgtgatgaagttgtggcaagaaatcattgacgacatgaacgagggggcggcaaaataatgaatttcttcgttaaccaatacctggtaactaaaaactcgagcattgaacacgccgaactaaagcgactggccctcttcaatggtcacgagcccgggtcggctaagctcttgacccaggactttgcaccgactttggatcagaccttagagcggtttgatttacagcgcgacgccgttattaacatgttcgacttttttgcgggcaccaccgactacgtgggggcgcccttaaaagtcgacggcctagcctatgacggcgacttgcagatggggaccgggaacaactttcgcgagttaaagcgcgggggccggctggtcagcgaggttcatttcattggcgggacggtcgcccaggtgggtaacgtcgattacttcgacgacgccggcaacctaaccctgcgccaaatctacgacctgcgcggtttcttggcggttaaccagtactacggccgggcgggcgaactcttttacgaacgctatcagcgcccggacggcaccgtttacctggagcgctactacgtccagtcaaccgaaaacacgccgatcaactcgctcaacgtcttaaaggactaccaggggcgcgaccgcttcttctatgaccaagagggactcttcaccttcttcttggacgaggttaaccgggcctttggcgaaaacaaccgcttctttgccgaccggccggccgtggcgatcaacccaattttgaacatgaccagccaggttaagcgttacttgtggctggcgatgcgggcggtggacgacggccaagacctagcaaccggtagcctagacacgatggtcgacgccgccttgcaacacggccgcaagtggaccggggtggtggttgccaccgcagcccaagccgccgacctgaagccgcgcctgccgaagggactcaagtgctacgtggttaataactccccggttaaagtcgaccgaacgccgatcttgattcaggaccggccggcccaacgcgtgattgccgtcgggcggctgggcgccgacaagcaaaccgaccagctaatcgacctcttcgcccgggttcacaccgcccggcctaaggcgaccctgaccttctacggttacggcaatcaagccgatatgcagtcctaccaggagcaagtcaaggcggccaacttggagcaggtggtcaccttcgccgattacgtggtcgacctcgagccggtgtacgaccaggccagcctgttggtggacgccagccgggtggacgcccagccgctagcgatggccgaggccctaagtcacggggtaccggtggtcagttacgattacgcctacgggccaagtgagctggttatcccgggccaaaccggagaactggtgccactgggcaaccgcgacgcctttgtgaaggccgtgatcgacttattgagcgacccaacgaagttgcaggacttcagcacggccgcctaccagaatttaaccccgtttagcgaagcgacgacttggcagcagtggcaagccctcaagtaggggcgccggacggttaaataaaaattctgagaaaattgttgacaaaaatgagaaagcccttataattaagcgtaacaaattaatcgaacgctaaaacatatcgaaaagcagagtaatcgttagcggctagcaagagagtttccggttggtggaagggaacagcttaaggcggtgaagatgggcttggaatggcaccggcgatagttagttggtgacggagttgcacacgttatcagtgcagggtaattccttgaggagtaacccgctaaggctaccagccgtgaggtggtagcgaattaaggtggtaacgcgaagcactcgcccttgatcaatggatcggggcgggtgctttttttgatggttgacccgttcgagagacacaaagaaaaaacaaaaggggagcataattatgaagaataaaaattggattatctggaccgtcgtggctgtggtgattgtcgtgatcggttggttctcatttggtcacagttcgcaaaccagtagcaagacggttaccgtcggggtggttggtcaaaccagtcaggacgaagccatctggaaagaaattgccaaggtggccaaggacaagtacggggtcacggttaagctcaagaacttctccgattacaaccaaccaaacaaggccctgcaaaacggggatgtggatttgaacgccttccaacaccaggccttcttagacgcttggaacaaggctaacaaggggactttggtatcaattgggaagaccttcatcaccccaattcacctttactccaagaaggtgactgacgttaaggacctgccggacggggcaacgatcgccgtgccaaacgacgcctccaacgaatcccgggccctcttcttgctcaagaacgccggcttgattaccttaaagaccagcgccggttccttagcaacggttaaagacatccaggacaacccgaagaacttgaagatcaaagaagtcgccgctgaacaaacggcccggaccttagacgacgttgacgccgccgtggttaacaccaactacgccgtggctgctaagttaccggacagcgaaatcatctacacggaaccagttaacaaggactccgaacaatggattaacttgatcgccgctaagaagtctgatgccaacaaggaagcttacaaggacgttgttaaggcttaccacacgagccaagtgaagaaggttatccaaaaggaatacggtaacaaggaaattcctgcctgggacctgaagttaaagtaagaccacagaaagcgtgagggagaatatggcagacattatttcattagaccacattgatgtaaccttcccccaaaagaagggggaaccggtccgggccgtttcggacgtcaacttgcacgtcgaaaagggcgatatttacggggtggttggttactcgggggccggaaagtcgaccctggttcgaacgatcaacctcttgcaaaagcccaccgagggaacggtgaccgttggcggaacggtcttgtttaaagaccacgcccaacaagtcagcaatgccgaattacaggccatgcgccggaatatcggaatgatttttcagcacttcaacctgttgaacgaaacgacggtggtggacaatgtcttgtttgccctcaaacacgccaagctaaaggacaaggaggcccaagaaaaggccttgaacctgctggaactggttggcttaaaggacaaggcccaggccttcccggtacagctgtccgggggggaacagcaacgggtggcgatcgcccgtgccctggctaacgacccggaaatcctgatttcagacgaagcgaccagcgccctggacccgcggacgactaaccagatcttggacctcttgcgcgacttgaacaagaagctgggcttgacgatcgtcttgatcacccacgaaatggacgccgtcaagcgggtggccaacaagattgccgtcatgcaacacggggtgattatcgaacagggcagcctgcgcgacatttacctgcggccaaagcaggaactaacccgccagttcgtgggtggctccctggccgccatcgaaactttgaaggccttcaacctgggcaccctggccgcaaacgagcgcctctaccagctggtcttctcggccaagacggtcactaagtcgatcatcttggagctctaccggcaaagcggggtcgacgtttcgatgctctacggtaacattgaggtcttaggcgacgaaccggtcgggaccctctttgtgatcgtaaccggtgatgataatcaacaggccggcgcccttcagttcttgaatgataatcaggtggaagtaacgcaaattgatgatcgggggatttggaatgactagtttcttaacgcattacatgcccaacgtggttcaactcggctggaccggcgataccgggtggggaacgtcgatcgtccagaccctgtacatgaccttttggccggcaatttttggggggatcctggggttgatcttcggggtcgccctggtgattaccaagccgggcggtatcttagaaaacgccttttggtttggcctttgcgataaggtggtctccttattccgggcgatccccttcattatcttattggccttcattgcaccgttcacccagctattagtcgggacccaaatcgggatgacggcggccctggtgccactgtcactcggggtctttcccttctttgcccggcaagtccaagtcgcccttgaatcggtcgacagcgggaaggtggaagcggcccaggccttgggtgctactaacaccgacatcatctttgacgtctacatccgcgaagcccgctccgaactggttcgggtctccacggtgaccctgatctcattgattggcctgaccgcgatggccggggccatcggggccgggggactggggaacaccgccatttcctacggttacaaccggttcaacaatgacgttaccctggtagccaccctcttggtcttgttgttagtcctgatcgtgcagttggtcggggactggttggcgcaacgtcttaatcaccaggcacggtaaagggagtgcgaccaacctccttgacgagccgtatgactaagctaggggtttaatatttaaaatcgcattggggccgggaaaaactaacttttcccggccccttttttcaatggaggaaattaatgatggatcaaaccgaacggacccgggtgcttagcgacctggtcaaaattaatagtgtcaacggcaatgaactagaagtggccaattacttgcgccgcctgtttgaacagcacgggttgacggccgacgtccagcccttcggcgagcagcgggccaacctgattgtagaggtgggcgccggtaaaccaatcctggggatcaccggccacatggacacggtcgccctgggtgatgaggggaagtggtgccacgcccccctgagcgccacgattgaaggggaccgcctgtacgggcggggggccgccgacatgaagtcgggcctggccgcccaggtgattgccctgattgaattggttgaatcaggaaccctgaccggtcacgtccgcttcatcgctacggccggtgaggagtacgggaccccaggtgctaaccgcctggaagaagcgggggtggctaaggacctgaacgccctggtggtcggggagcccaccagcgggaacgtcatctacgcccactcgggaagctacaactaccggatcgtttcaactggccaggcggtgcactcttcggaaccggaacgcggccaaaatgccctggagcccctggtcgactttgccctggccgaacgcgacctcttctttgacgttccggatgacccctgcctggggccgctcaagcactcggtgacgattattcaagggggcgagcaggtcaacacgatcccggactacgcggaactgcgggggaacatccgccccacgatgcgctttgataacgaccacgtcaccgcccgtttgcaggccgccgtggaccgtcttaaccaggggggtgctacccatttaaccctggaagtgctccactcctggcgcccggtggcctcctatcccaacggtgactttgtcaagcgggccctacaagctagccaggaggcctttgcaaagtacccggggcacgcgaccccagaactcggggtcatccacggggcgaccgacgcttcggttttcgtcaagcaccaccacgacctgccggtgattttactgggggccgacgactggaacatttcccaccaagttaacgagtacaccaccctgtcctcctttgaggcaacgattgaagcatacaagcgcttgatcccggcctttttcgagtaacggcgagtggtcaccataaacaaaagccgggcaccacgcaatcttattgcgggtacccggctttttactgtttgactagtgccaccgcagtccaaacggttggtccgcacttctaataacgtgctcccaaccacgggcttaatgcctaagtacggccggagaacgatgcgtgccgcatcaacccccgtcctagcttagtccaacggcccgtcgaggaggtttagtcgcacttcttataacgtgctccccaaccgcagacctagtggctaagtccagccacagaacaccgctggcgcgctaacctgtgtctaggccttagcccacggcctgctgatagttggtccgcacttctaatcttcattcaagaccaacttaaccaccgcttcgcaccggggcgtttgcggtagcatgtcgaccggctggatgtaagcaacccggtaggtcgggaccaggcgggctaggttacgggccaaggtggccatattgcaggagacgtaggcaaacttggccggcttttcctggaggatcgtatcgatcaaggcgttgtccagcccggtccgcggcgggtcaaccaccagggcgtcaaagtgttggccctgactgcgccatttcggcaggagctcttcggccgggccgacttcgtagcgggcgttggtgaccccgtttaaggtagcgttattgttggcgtcttggacggcgtcggcgatcgtctccatcccgatcacttgcttgacccggttggctaaggacaggccgatcgtcccgatcccggcgtaggcgtcgatcagggtgtcgtccttggacaggtccagggccttagccgcttcttcgtatagaacctcggtttgttccgggttgagctgcaaaaatgaccgtgccgacaggcggaagtccagccccatcaggctctcggtgatgtagtcttgcccgtacaagagggtggtctcgtcgccccaaaccaggggggtgtcgccggggttgacgttttggaccaccgaggtgacttcggggagttggtcttcaatcgccaccaagagggcgtgttttttgatcaacttggccgtgttggtaatgatggccacctgaatttgtccggtcgccagagattcgcggaccgccagggtcttgatgatcccggaccggttggcttcgttataaaccgggatcgccaattcctcaatcagtttgaccagggtgttgatgaccttcatcgtccccggcatttgaacggcgcaggtttgcatgtcgacgacggtgtggctgttggcttggtaaagtcccgccaccacgtgcccatcttgcacgcggacctggaactgggccttgttacggtagccgtaggggtgcggggcggccaggggatccttaacccagtagtggcggtaacccaggggcttgaacttggccagtgcctctaagactacctgctttttaaaggccagttgcttatcgtaggccagggtttcgagttcaaagcccccggccagcccagcgtaggcgtccttaggtgtgacccggtccgggctgggttggcggagttggtggagcttggcctctaagtagttgtcgtggacgacggtgacttcagcgacgacgacttctcccggcagggcgccggggacaaagcagactttgtgtttgaagtagccgattccttgcccctcgaccccgagttttttaattgacagggggaagcggtcgccgaccttagcgtcgaccgggtgggcgtagcgcttgggccgccgcttgaaattacggtgtgttggtttttgcatgttaatacctcttaatttgtaacggacagtttggtgctttcctattttagcacacccgccggacgaaaactttttggggaaattatgagaaagggattgacgaataataagggcgccgttaggattattcacataaattgaatcgtccgaacgcaatgagaaagaagagtagcacggcgacaccgcaagcgagccccggttggtggaagggggccggaaggttgccgtgtgaaaatcactttcgagcctgagccaaccaaggttcagtggtacacacccattatcgtgtgcgcgtatcgcctactgggccgtacgcagtaaggttggcctagcgatgggccggcaaagaccaaggtggtaccacgcaaagcgtcccttaaccggagtttccggttagggggcgctttttcgttactgacttgcgtttggattagtttatggagggatttgagagtgtcaagaatgttgtgtaaaaagggaaacttcgcccgcatgaattggcaattctaaaacatcgaatcaagcgtgtcgtgacagtccttgaatccccgatgtgctcgattctcaaatttatgacccagcaggtcgaaaaaagcctccagcgcctgggcaccgactacttagacatcttttatatccactaccccgaccaagacacccccaaggccgaggcggtcggtgctttgcagcggctcaaagaagcggggaagattcgggcgattggcctgtcgaacttctccttggcgcaggtcaaagaggccaacgccgatggttacgtcgacgtggtggaagacgagttttccctcctccaccagcaaaacgcccgcgacctagtgccctacttaaaggagcaggggatctcctttgtcccttacttcccgctggcttcgggcctgttgaccggtaagtacgaccaggcgaccagtttcccggccgatgacatccgcagcacgatggccgattttggggagccccgctttgggaaaatccgcggcgccctggcggtggtccggacaattgccgctagccacggggccacggtcagtcaggtcgtcttggcctggtacatgcaaaacccactcatcaccgccgttattcccggcgccaagcaaccagaccaggtgatccaaaacgccgcggcgctccaactggaactgacgcccagcgaataccaaaccatcgaagaggcctttgcgggctttaagtaaaaaacgggacccaaccgcatgttgcggtgggtcccgttttatgatgctcgacgatagaagtaagtggctaggctagcttagcccatagcctgtcgaggaggttggtcatcactcactttactttaaatacgcttgttcaaagttgtcgaggttggtggtgcttggcttcaagttggcccacttagttgataagaaggcgtcgtttaacttgtagttgggcgccggttgcttattttcgatgaaggccgaaacctggtggtcaaacttgacccagccggcccagccgaggtggatcgtatcctgcatgaagcccttcttggccccgtccttggagtaatccaggatgttgttaaagccctgcgattgcagctggaacttgatctttttgaccgtttgttcgtacatcttcattgacataccggtgtacttttcccacttagcgttaaccggggtgatcatgaaaatcacgtcggtgttgttcttttggaactgctttaagaccacttctaggtcgttatattccggtgattgcaggtaggtgaagttcttttgggccccctttaagttcttgacgctcttctttaggcgcttggagtaaaaggggtttaggatcccaaactggttgttggtcgattgttcggcgtgcatttgcttggccatcgtcatcaacttttggtagttgtactggcgtggcaactgggtgatttgcggggcaatcttattgccgtagttgttgttcaagaagaagcccgagaagagctggtcttcgtgagacaggaaagtcaagcggaccttgaggttagcccggtcggcggcggataaggcttttccggaggcgatcttgtaagccaggctggagacgaagccctggtcgtttaagaggatcactaagcggctggccgtatagcgatcgtaaggggacttagggttcgcctgttcaagccatgtaatcggcgtagttaccgttgtaatacttaaaggcctggggggagaccccttgcttcacgaaccactgcggggaaatgatgtagacggccttgcggttcttgagctgcttgttcatcattgccatgttaaagagttggggcaatgattgcgttccccgggaaccaaacaaaaacggcttgtagtcgtgataacgagcggccattaccgacgggtggaagaggtccatccgggcaagttcactggaaccaaagaagggcacgtaattagccttcttgtcacttagggccgccaccttgaggttacggtttttaaagaccgtagcggataaggaatcggcggccttttgctcaatcgccggggtgttattaaacttccaggggagcaaaaagaccaccatcaccattaggatggccacgatcagcgggccaaagattgaccacagctttttacggttgctcatcggtcagctacccttatgcttgtaattccttgacccggtcggcgatcttgttgaccgtgttccattcgtcacggtcaaattcggacaccggaacggtgatgtcgtattcgtcttgcaaggagaagaggaattgaacggtggccatggagtcgatcaaaccggagtcaaagaggttttcgtcggcatcggcgaagtcagcggcgtcacggccagttgcttgggctaagagttcttgaatcttttcaatcatggtaaatacctccaaatgttaagtcgcggctacatcccgaacgggtggaaccagagtttgtctaagaaaccacagaagatcaacagtgtgaaaacaacaaagttaaaggtgataaagatcgcgacgcccttagtaaaggcgttggtcttgatcttgaagtgcttgtgcttgtaccgcagccaccagtcgttgacgaccagggccaacccgtgcaagaacccgtagaggatgtaataccaggtgaccccgtgccagaaccccatgatcatcatgttgagcatgtaggccgtcgacgagaggacgttacggtttttaaaccagcgtttcttggtggccaagaaaacgaagcgcatgaaaatgtaatcacggaaccaaaacgacaaggtcatgtgccaacggttccagaattccttgatgttgggcgatttgaacggctggttaaagttcatcggcgtttcgacccccatcaaataggagatcccgacggcaaacagcgagtaaccggcgaagtcaaagaagaggttcccggtgtacatgtaggcgaccccaaccgtccaccaggagaggtggggagcgtgttgcatcgccatccgttcaaagaagggctgccactgttcggcaaagaagtagtcgatgacgaacttgtataagaacccgatgaacaggtacttaacggccttgcccagcatttcgaggtacttttcgcggctcggcaccttcttgtaatccttggcaaagcgccggtagcggtcgatgggccccgaggtcagggttggcatgaagagcatgaagcggatgaattcccaccatttgagctccttaaccaccccgtcacgggtttcaatgatcgtaccggccgcccggaaggttaggtaagaaatccctaggaaaccgagcagggagttatgaccaacaaaggccggggtgaacttgacgatcacgatcggcaataacgacagggcgacggtcacgtaaaagaccaggctgttgtttttttgctggcggtagtggaagtaccagatcaccaagatggtctggtaaatcaggtaaccaattagggaaaggccctgcttataactggtcccgtcaaacatcaagaagatgaagataaaggagatcagggcttcgtaccaggagaaacgcttgccgaagtaaagtccgatcgacaggggcaggatcgccacgatcaggtagatgaagtaaagcggcgttccgtacgcggtgtaattaggaagggtttgaatccaggttaacattactcgttagcctccgcgatcatttgcttaaccgcaatcttaccgttggccgaggtcgggaaggaatccacgtagacgaactgggtcggcatcatgtagtccatgatctgatcctttaagtcggcccggatcgccttggtcagcgccttgtcgtctgcaaagtcgttatccttggcgatgatgtaggcgatcaggtgggaaaccttgccgtccttagcgtactttggtacggcgacggcttgcttaacgtactggctaagctcaaggctggagcgaacctcgtctagttcgatccggaaaccgtggagcttgatttggaagtccatccgcccgatgatgtggcgcatcccgtcttcatcgatgtagccggcgtccccagtccggtaagcttggaccccgttgagcttgaagaagttagccgctgttttttccgggttgttcatgtagccgggggctaccgactcgccggcgatgatgatttcaccgtgaacgtttggctcggtcacttccttgccatcgtcccagatggaagtggtgacgttgggcttgtcgtagccgatcggcaggcgcttggccgtagcaaccatttccttggtgatttccacgctggtaatggcgacggccgcttcggttggcccgtaagtgttaaagatatgggcgtccgggaagtttgtaaacaagcgcttggccgtcgaaacggtcagttcttccccgcagaagaggaagtacttgagttccggcatcttctcttggttgaagtccggggacaacaagagcatgtcgacaaaggacggggtcgaaacgtaaaccgaaacgcctaactttggcacgaccgtaaagagttggccaaagttttggaccaccgtccgtggcagggccttgatcgttgacccggtcaacagcgctggtagccagtacatgttcgataggtcaaaggaaaacggcggctggccgaggaaggtttggttgtgggggaggttgaaggcgtcagacaccatccaactggcaaaggagcagatgttggtgtgggtgatttcaacccccttgggtgacccggtcgtcccggacgtgaagaggatgtaaaacaggtcgtcgccgtcaacgaagtgatccagttggtagtcgacttcttggtggagcaggtcgactaactggtcgtggttgaccacggtgccagcaaagtcaagttcgtcagccgggaagtcatcgacggccagcaccatttgcggtgtggcggtcgttaagatggaattgacccgcggcagggccgaatcggtttccaccgggatgtaggcgtgaccggcctttaagcaaccgatgaaggaagccatcatttcaaactggtggtcaccgtaaatcaaaattgggctgttagcgggtaagttttgttggtctaaccacgccgctagcgcattagagtagtggtaaagatcgccgtaggagtggatagtccccagctcatcgaaggcggggaagtccggttgcgcttgggcgatccggtcaatttcttgaataatgttttgtaccaatgtaattactccttttagaactcattgtagataaacggagcttgtccggccccaaagtagccgtacatgtagatcagcaccatcaagacagcaaaataaaaaagcgttcgcaaacaaaacgccaccgcaggacgatccttcagcatggtcagcggtgctcctttctgggtattgttctgggttaaccaaggcttaattttactctatctttgaataaaaaatacttaaattgtggttaaaatataaacttaactcaattttagcgtgatgagtaaagattgtaaactaagaccaagctaccaagcgttgaccagccccagaaggaagtttaaaataattaaacaaacacatgttcagaggagggggaacgaatgaggtttctacacactgccgattggcacgttggtaaaaagttgaatgggttcgatttactggccgaacagcacgacgccttcttaaaaattaatcaattagcaaaggattataaagttgatgccgtggtggtcgccggggacctttacgaccgctcagttccaagcgaagaggcggtcgaagagttaaacaaagacttaattcaaatgaatcttaaggaaggttggccactcttggcggtctcgggcaaccacgattcggcggtccgtttagccaccgggggggactggtttaaggcgaccaacttctttatgcacaccacggtcgcccaggccatcgaagagccggtcaccctgggcgacacccagttcttcttgctgcccttttttggcctccaggaggtacgtaattactttggtgacccggagatcagggatttaaaaacggcaatggcccggatcgtgactaagatggaagaagaatttgacccggaccgcgcccacgtcttggtggcccacttctttgcggccggatccagccacaccgattcggaaacccaaaccgaggtggggggcctcgatgcggtaccggttgacctgatggcaccctttgattacgtggcgttgggccacttgcacaataaaaacgcccttcaagcaccgcgggttaagtacgccggatcaccgctcaagttttcggcgagcgaggtcaacctcgataagggcgtctggatcgttgacacccagccctttaaccttcagtgggtccccttagagccgctccacgacctagtgaagctaaccggctcctttgacgaactggcaacggtggagtacgccagccactaccaggaggacgacttttttgtaattgagttgaccgatacggcgccgatcccagatttgatgaacaagctacgccactactaccctaaaatcattgcccttagccgggtgaacaaggccgctgaccagagtgatctagcggcgcccgcgcaggacttggaaaacaaggatccgctggccctgttgagtgacttttaccaccaggtgaccggcgaagagttaagcgataaccagtgccagtgggctaaagacgccctgctagcagcccaaaaggaggaggaaggatgaaaccactcaagttaacgatgcactactttgggccgtacgaagacaccacgattgacttcaccaggtttgacgctagcccgttatacctgattgccggcgacaccgggagcgggaagacgaccatctttgacgccatgtgcgtggccctgtacggcaacgcctccaacgagcgccggtcggccgaaatgtttcgctccgactttgcgacccccaagcaggtgaccgaggtaaccttcctatttgaacataagggggtcacctaccaagtctaccggcggccacggcaagtcctgacgatgacccggggcaagggggaaaagcaatacgacccaaaggtttcgctagtgtacccagttggcgctgaaaacccccgtgagttgacgaagatcaccgaggtcaatcagttcgttcaggaccttttgggggtcaacgccagtcagttccgccagctgatcatcctgccccagggcgaggtgcaacgctttttaatggcggattccaagaccaaagaagagatcctcaccaccctctttcaaacccagctctacaccaactgggtcacgaagctggatgagcgcgccaaaagtatgcgtgatcaaacccaagacatcaccagtcagctcaaggtcctgatgggccaagttgacggggttagcgaccagctagagctcgaccagtggcaagtggcggtcggggacctgctgaccgaaaaaaaggcggagctaagggcggttaccgaacaagtaaccacggcacaaaaagcggccgaccagttgcaagcccagttgaccgcggaacggcgcttggccgaggaccacgctgcgttagtttcctgtgaaacgcaacaattggagcttaaagaacgggcgccgcaaattaaacgcttggccgacgaaaacgaagaaacggcgtgggcccaacaacaccaaacggcataccacgagtggcaagccgggacgaccaaactggcggacctcaccaagcagcaagcggcgtgtgaacaaaaacaagccgcggttaaggtgcgggtgcaagaattgacccaagtggccgaacggttaaaggaacaagaaccggccgtccaagaacgccaacgccaagtggccaacattcgagagaagctccccctctttgaagaggtggccgccctaagtaagcggctggaaaaagagcgccgggcccaagttgaacaagaacggacggttagtgaccaaacgagcgccctgactaagttacaggccgagttagaccgggtggatcaggaactccaagccgctcccgacctgacccaagcggcggttacgattgccaccagggtccaacaagtagtccgctggcaacaggcagtgaccgccctcggggagcaagccaaggagctggccaaccaggagcaagccctgcgtgacctaaacgctcagcttgccgaggctaaaaaaaccgcccaagccgctcaagcggaccttaaagaaaagaagaaggcccgcctcgccgccatgattgcaaccctggctagcgagctggaggaaggggaggcctgcccaatttgcgggagtaccacccacccccacgtcgccacggcggtgcaaacgggccaggaagtaaccgaggtaacgctagatgcggcccaggcgaaagtgaccaaggcggaaacgaccctggcgactttaaccacgcggcaagcgaaccaagacagccagctagaaaagggacgggcaactttccaagacgaattggcaacgctttgccaagccgtggcaagcccagtgggtgacctggaggcagccacggcggccgtggccgaagccgtcgcggcgctggaccacgaccgccaggaattgcaaaacgcccaagctaaggaaacggaaaaccagcaacgccaggtaagcctgaccaagcagatccaggcggggcaagcaaagtaccaggaactgcaagcagcggtcaatgaagggcgcctgaacgtcaaccaaacccaaaccgagttagttaacaagcagggccagttgcccgccgaactgccggacctggcgagtgccgagcggtggctaaaggaagaggaacaggcgttagcggactttgccagccagcaaacgcaaaaccaggacgcccttagtcgggcccaaacccaattaacccaactgaccaccacgagccagcagctagcggacagcgccaaagcgaccgcagccgaagtggaccaacgcaagcgggaactaacggcggccctagcagaacgccaagcagcgtgggaggtctttgaacgggccctggcccgcgttccggaactggcggcccgccaaagggaggtcaacgactaccgtcaacggctggcgagcctggccgaccagcgccaacggttggtggaacaaatcgccggccggcccaagccggacgtggaaaagacggcggggcagttgaagaaagcccaggtgaagttggaccagctcaaaggggcggtgattgaacaaggcaacgccctgacgcggatcaaggaaattaaacaacaagtcaaaaaaaaggcggctaagcagggcgacaccgagcgccaactgcgggaactttccagcctgtgcgccctactcaagggtcagggtgggacccagttaggcttgcagcggtatgtccaacgccactactttaccgaggtcttggcggtcgctaaccagtggctagctaagttaacccacggtcgctaccaaatgcacctggatggggaagccgactttaaggggcggcagaacaaaaacgggttggaaatttacgtcgacgatgactacgccggcaaagcgcgcaaggtgcaaagcctgtcggggggtgagagcttcttgaccgccctggcgctggcgttggccctcggggaagtcgttcagcgccaccatgggggcgttgaaatcgaagccctcttcgttgacgaagggttcggctccctagatcaagacgccctgggtgaagccctggataccttgcaaagcctggacggcaaccgaatgattgggatcatcagccacgtgaccgagctggaggagcagatccccgatcagttacaggtgatcgcggagaatgggcgcagcaaggttaaatatcacctggcaacggactaatttcccgggaaatagttgccaaggacgagcgactatattaaaatggctgtaatttcaaaacacggggtgcttcaagtaggaaccaagagagctggcgggtggtggaagccagcttccgaaactccggcaccatcaatgtgggcgggtaatgccgcacggtctggtggccgttattcatcatagagcgtgctgatttcagcaaacttgggtggtaccgcggaacaagagccatttcgtcccaactgtggaacgggtggctctttttgcattcattttgcattcataaggaggaatttcaatgttagacatcaagcaaattcgccaacaaccggactggttcaaagaaaagctggccacccggggcgttcaaccagaagaaatcgacgccgtgctggaactggacgccaagcggcgcgaactcctgcaacgaaccgaaaccctgaaggccaagcgtaacgaagcctccaagaagatcggggaagctaagcgggccaagcaatccgctgacgaagcaattgccgagatgcgccaagtcggcgaagacatcaaggccttagacgaacaggtggaagcaaacgacaaggacctctttgacaagttagcccacctgccgaacgtccctcacgaaggggtgccggttagcctaaccgaagatggggccgaagaactgcgtaaggtaggtcaagcccgtcaattcgactttgaaccaaagcaccactgggaaatcggcgaaaacctcgggattttggactttgaacgggccggtaaggtttccggctcccgcttcgtctactacgtcggcctcggggctcaattagaacgggcgctgtacaacttcatgctcgatgaacacatgaaggaaggctacaccgaagtcttgccgccgtacatcgtcaacgctcacgcgatgtacgggaccggtcaattcccgaagttcaagcaggacgtttaccaagtgaacggcgaagacatgaccctgatcccgaccgccgaagttccgttgaccaactactttgccggcgaagtgatccctgcagaaaagctgccagtttacgtgacggccttgacgcctagcttccgttccgaagctgggtcagctggtcgcgatacccgcgggttgatccggatgcaccaattcaacaaggtcgaaatggttaagtacaccaagcaagatcaatcctgggaagaactcgacaagatgacggccaacgccgaaaacatcctccaaaagctcggcctgccgtaccacgtcatcaccctgacgacttcggacatgagcttcacggcttccgaaacccacgacctggaactgtggatgccggcccaaaacaagtaccgggaagtttcctcttgctccaactgcttggacttccaagcccggcgcctgcacatgcaataccgggacgaaaacggtaagctccaatacgtgcacaccctgaacggttctggtttagccgttgggcggacgttggcggccatcttagaaaactaccaaaacgaagacggctccgtgacgattccagaagtcttggtaccgtacttccacggcatcaccaagatcaccaaggaaaacgccgtgccgtttaacaacaagtaaaaagagagtgtcaaacaaccgcaggcctgctggttgtttacaaaaaagcgggaacgtaaccatcaggaaacgtccccgctttggattttaaaagggtagctagttgaccgccccgatcgccgtgccataatgacaatttaaaagggaggctgtgaagggcctcccgagtagcgccgtcaaaaacggtggcatgcaatttggttaaataaccgctagctttgcagggctaaggcggttattttttaaattaattcgaccattttacttgccttttgggcgaatagttgataagatcatatccgtccttaaatgacccgttggtcaagtggttaagacaccaccctttcacggtggtatcatgggttcgaatcccgtacgggtcacttttcaaagccattcgcagtttgcgggtggtttttttcgtattaaaaagctccagcaccgccttacagcagtgccggagctttattttgatttacccatatttcccgggcaataaatcctacttgaagtagtttaaccccatcgcatccttgacttcatccagggtctgggcggcgacttggttggcccggtcgctgccggcctttaacatgtccatgacggtggggaggtccttggcgaattcggcgcgccgttgtcggatcggggctaactcggcgttaaggacttccatcaggtaacgcttaatcttgacgtcccccaggccaccgtggcggtagtggtcctttagctcttggaccttagcggtgtccttgtcgaagatgtctaggtaggtgaaaacgacgttgccttcgacttggcccgggtcttcgacgtgaatgtggttcgggtcagtgtacatcgacatgacctttttctttagggtgtcttcgtcatcggataagtagatggcgttgcccagtgacttgctcatcttggcgttaccgtccaaaccagggatccggccctgcccctttggcgggaagaccccttctggttcgaccagcacttcgccgtagatggagttaaaggtccggacgatttcgcgggcctgttccagcatcggttcttggtcgtcaccaaccggcaccaggttggccttaaaggcggtgatgtcggcggtttggctgaccgggtaggtgaagaaaccggccgggatcgagcggttaaagttcttttgttggatttcggccttaacggtcgggttacgttccaagcgggaaacggtcaccaggttgaggtagtacaagttcagttcggccagggccggaatctgggattgcacgaagagggtcgacttggccgggtccaggcccaccgccaggtagtcgagggccacttcggtcagggagcggcggatcttttcggggtcgcgggcgttgtcggttagggcttgttggtcggcgatcatgatgaagggatcatattcgccgctttcttgcatcttgacccgttcgcgcagggaaccaacgtaatgcccgatgtggagtttgccggtggggcggtcaccggttaaaataactttctttttcatattaaattcctttccgtggtggcgccaataaaaaatgccccaccccccgaggaggataggacgaatgaccgcggtgccacctatcttacggggaaattcccgtcacttattggtgtattgcaatgttgaccgcggctccaattcgaaggggcgccggctgtttcaccaaggtcagccgtctctgtttgagcaccttctactgttttcccggtctgattattgactattgtaagccctacttaggttcttgaaaagacctaggcgtggacttttgccagggtgtagttcttcttaccgcgccggatgaccacgtacttaccgtcaaacttagcggtggggtcaagggtggcctcaaggtcagtcaccttctcgccgttaacgcgaatggcgccgttcttgacgtcttcgcgggcctggcgcttggaaggttcgatcttagtgtcgaccagccagtcgacgatgttggccggttcggcacggacctcgacgctcggggtgccggcaaaggcctgttcaacttcggccgtcgtcaggtcttggatgttaccggagaagaggatggccgagatctttttggcctgatcggtagcggcttggccgtgaacgaaggtggtcacttcctgggctaagcggcgttgtgcttcacgcttccacggttcggtctggaccttttcttctaagccggcgatttcttcttgggataagaaggtgaagtacttgaggtacttcacaacgtcgcggtcatcttggttcaaccagaattggtagaattcgtacggcgaggtcttttcgggatcaagccaaacggctcccccggcggtcttaccgaacttggtcccgtcagccttgagcatcagcggaatcgttaccccgaagaccttggtgtcgctgccttcaaccttgtgaatcaggtcgatccccgacgtaatgttcccccactggtcggaccccccgatttggagttggacgtcgttgtggcggtagaggtgcaagaagtcgatcgcttgtaggatttggtaggtaaattcggtaaaggagatcccggcgtccaggcgggaggcgacaacttccttgttgagcatcgtgtttaagttgaagagcttcccatagtcgcgcaagaagtcgatcatggtgaacttggacagccagtcgtagttgttaacgatcgtaaagttttcggtcccgaacaagcggatcatttgcttggtcagggattggacgttttgttctagtttggacctcgtttccaggtcccgttccgtcttgcgcccggagggatccccgatggccccggtccctcccccaatcaggatcaccggcttgtgaccggctaattggaaccgcttgagcatcatgaagggaattaaatggccgatgtgtagactgtcaccggacgggtcggtcccacagtacagggcaatcttcttttcttcggtcagttcccgtaagccttcttcgtcggtggcttggtttaaggccccgcgccacttcaattcatcgataatgttcataatggtcctccaaagtaatggcatttccgttttaaatgaaaaaaagagcgcccctatgccttagcacagggacgactcagccgtggtaccacccatttttatgcgtaaaaacgcacctcatttaacgcggattagattaaaaattgatgggagtgtaattcgaagaccgcccgtgcgctaatttccaaccaccattagctcccttggccagcgggacggcttctactgggttcccatcacaatgtaactatttgtgaatttaccacgggaactgaccggtgtcaaccagatttagactttacaaaattaagtttttagcggagttgagcttaacatttattctaaggaaatgattacaaccttttaattgacggttttgggcaactttacttttcgttaaggtttacaagtgatagagtagtaaatagtaactttaaaaatctaatgatattgtaagggagtggtaaggatgaagcattggctcaaacgcgggctaactagtctggccgtagtcgccggagtcgtactcggattgatggtggtcggcagtgaacctgcacacgccgaaaagacctacacgatcgggacggtcgacacattcgaacccttcgaaattcaagataaaaacgggacctacaacgggaaaaaccccgggattgaaattgaaatgctgcgcgaaatcgccaagcacgaaggatttaagtacaacttaaagatcatgtcttttaacgccaccttaacggcgttggaagctggtcaaatcgatgctagcatgggtgggatgtcggttaccgacgaacggaaggccaagatcgacttctccaagtcctactacactgacggggtcgtaatggcggtgccggaaaacagtaagatcaccaagctcagccagttaaagggtaagaccgtcgacgttaagtccgggacctccagcgccatttacgctaactcggttaaggacaagtacggctttaaggtgaagtacttcaacacctccaacacgatgtggaacgacgtgatgaacggcaacgccgcggccaccttcgatgatggcccggttctgcaatacgggatccgaaacgggatcaagcttaagatcgtcaccaaggaaattaactcgacgccagtggccatgggggttaagaaggggcaaaaccaagaactgctcaacaagttaaacgacgggatcacctggctcaaggaaacgggtcggatgcaaaagatcatcaacaagtatactaagggtgacgctgccaagaccgaaacggacagcgaccggagcgtttggggcctgatcaagtccaacaaggacgccctcttaagcgggttgggtgaaaccctgctcctgaccgtcgtcggagcagccttagccctcttgttcggggttatcctcggggtgatggggatctccgacgggaagatcttctcgtcgatttcttctgtcatcatctacatcttccgggggatgccaatgatcgtcttggccttcttcatttacatcgggatgccgtccgtaatcggccacaagattccgctctttaccgccggaattttgaccctgatgcttgacgaaggggcctacgtcggggcgatcgttaagggtggtttccaagccgttgaccgcgggcagtgggaagccgctcgttcgctggggctaccatactacaaggccttagtgaaggtgatcatgccacaagggatcaagatcatggtgccgtccttggttaaccaattgatcatcaccttaaaggacacgtcaatcctttcggcaatcggggtcatggaactgacccaaaccgggacggtcatcatcgcccggaacatggaagggttcaagatgtggttaatcattggggtgatctacatcatcatcatcaccctgttgacttggctttcaaactacgtacaaagaaagatggcttaaattatggataagaaatacaaagttcaagtagtggacctccataagagctatggcaataacgaggtcttaaagggcattagcctcaacgtgttaccaaacgaagtggtctgcgtgatcgggccgtccggatcggggaagagtaccttcttgcggtgcttgaaccggttggaagaaaccaactccggccacgtttacgtcgatggttacgacattgccgacaagcacaccaatatcgacttggtgcgccaaaacatcgggatggtgttccaacactttaaccttttcccgaacatgaccgttaagcaaaacatcacgctggcccctacccagctcaagaagatgaccaaagaagaggcggacgaagccgccctcaagtacttggacgtcgtgggcttaaaggacaaggccgacgtttatccaacgacgctgtccgggggagaaaagcagcgggtggcaattgcccgggccctggcgatgaagccggacgtgatgctctttgacgaaccaaccagtgcgctggacccagaaatggtgggggacgtgctggaggttatgcaaaccttggctaagcaggggatgacgatgatcgtcgtgacccacgaaatgggctttgccaagcgggtagccgatcgcgtggtcttcttccatgatggtgtgatccgcgaacaagggacgccggaagagatctttgatcacccgcaacaccctgacaccaagagcttcttggacaaggttttgaatgtgtaattaaggaagtggctgggagaaaattttcttccggtcacttttatttcactgactgttatactgctaacgtggaaaacaaccgcagacctagtgcctaagtacgggcgaagaacggtgcgtgtcgcaccaaccgttcgctctagcttagtcatacggtctgccaaggaggttgttttccacttccctttttgttcccagaagctcggtcatttatggccgagtagttcacaatgtatatcggttgacatttagtcagcgacggttataatagaaattaaattttaattagaggttagcaaagagagccggtgggagctgcaaagccggtcaaaccgaatggcatgtgcgcgtacaaaaagggtggttcctttattgaccgagaggtagacgacaagtctatgaagatgggtggaaccgcgtgtgatgacgtccctggtattaattaccaggggcgtctttttttatcaccaggtttcccccaaatcacacgcaggaggatagagagaatggataagcaaactgaaacgcaaccaaagctgtcacgctcgttaaagagccgccacattacgatgatcgccattgggggcgccatcgggaccgggctattcctcggttccgggagtgccattcgggccgcggggccggcgattattttgacctacctgattgtggggatcttttgtttcttcatgatgcgggcgctcggggaattgctcttggccgacccgtccaagcactcctttatcgattcggtcaaggagtacttgggtgaccggatggaatttatcgccgggtggacgtactggtcttgctggttatcgctggcaatggccgatttaacggcgaccgggatttacctcaaatactggttccccaacctgccacaatgggtggggccgctggtaatcgtcgccttattgatgctggtcaatatggtcaacgtcgggttattcggcgagttagaaagctggttttcgacgattaaagtcgtcgccattattgccttgatcgtcgtcggcttagctatggttctcttccacactaagacccacaccggctacgcctcctttgccaacctggttaaccacggggggctgttcccaaccggggcgtacggtttcttgatgtcctttcaaatggtggtctttgccttcgtggggatcgaaatggtggggctgaccgctggggaaacccgcgatcccaacaccgacatccccaaggcgattaacaccttgccaatccggatcgggctcttttacatcgggtcaatgatcgccatcatggccgtctacccgtggaacaagatcaccacgacttcgagccccttcgttcaggtcttcaccgggattggggtgacgtcggcggccgccatcttaaacttcgtggttttaaccgccgccatgtcagccaccaactccgccatcttctccaccagccgctccctgtacgcactagcaaccggtggtaacgctccggagaagtttgccgacctgtccaacaaggcggtgcccaacaaggccctgaccttctcgtctttaatcctgtttgtggtcgtgattttaaactacgtcatgcccgccgggatctttaacatcatttccggggtttcgacgatcaacttcgtcttcgtttggttaatcatcctgtggtgccacatcgcctaccgcaaacaacacccagaggggatcgccggcttttcgatgcctggttacccaatcactagctgggtgacgattatcttcttcatcttcgttttgattgtcctcttcatcgtgccagcaacccgggtttccctgatcatttcaatggtcttctttgcctgcctcttcgttggttactacttcttggtggagggcaaaaaggtgaccgagaaaaattagttgtcgcttgaattcggaaatcgctttcattataatgaaggtgtggaaggattcaagtaccgttgcctaatcaatcgagaagaatcactcgtcaacgtttgttatcaacaatttgtagtaacaatactcaccccacatcacatcaacccattaaatttcctaaagactagttgtcggtttagcaatggcgctttgccatctccttggtacacgaaagtaattcgtcaggtaaacaaaattagcttaactgtccaaacgcaacggcagacagtctttccattacttcactagccacctcactccggtggctagtttttttagtttgagggtacaaaaaagggtgcctggatgggcacccgataccgatctggtcggctaggaaacaccaaccgcacacggcctaatctgcgatcttatgtgtaaatgtgcaatccgaacgatgacctcaaatggtcggtttagcgattaaccaagtaaaacgattgatttagtgaaaacgggtgcacaaaattaggggataccagaaaggggcttgttaaatcacgcttaacaggctccggttagaaaatttaaaaattagtttgtgaaattttggaaccgtttccgaacgtcggaatgttgatgtaaaacgatgtactgacgaacgttagggaaaacgctatcatttttcacaaagatcgccaagggaggcgctttacttttccttaatcaatgttattcttgctttaagaaatgattccccccactggtttgctagcggagggatctttgttgctattattcattaaattaaggaaaggtgttttcccatgtatcttgcaatcaatattcttgggataattgtcttcttggcaattggattcctcttctccaagaacaagaaagcgatcaactggaaggccatcgccatcatggtggtcctcaacttggtcttggcttggttcttaactggttctgctgccggacgtgccggggttaaggctgccgctgacggctttgcctggattgttgatatttcctctaccgggacgatcttcgcccttggtggttggtatgacgcaaagaacttaaacttcatctgttcggcactgatgccaatcctgatgattgttccaatgtttgatatcctgacttacatcggggtcttaccttggatcatcaagtggatcggacggggcctgtcctttatcactggccaaccgaagtttgaatccttcttcgccgttgaaatgatgttcttagggaacacggaagttctggccatctccgggatgcaattacggaagatgagtcgcgaacggaacctgacgatcgccatgatgtcaatgtcatgtgtgacggcgtcgatcttaggggcctacatcgaaatgatgccggggcaatttatcctaacggcggtgccgattaacattgtcaactccctgattgcgactgcgttaatgaacccaattgttgtaccagaagaagaagacacgattgaaaccgtcaagcaagaaggtgaaaagcgtgaaccattcttctccttcttaggggattctattttgggcgctggtcggttaatcctgatcattgtcgcaaacgttgtagcctttgttgccttggccgccttgattgacaagctcttggccttgatctggaagccactctccttggaagccatccttggggtcatcatgttcccattctcctggttaatggggctgccagtgcaccaagcctggatgctttcccaagacatggggatgaagctggttaccaacgaattcgttgttatgggtaaggtgaccggtgtcatcaaccaatacccagaacacttaaaggccgttttgaccaccttcgtaacgtcctttgccaatttcgggacgctcgggatgatcatcggggccttcaagggtctggttggtaaggaagataacgactacatcgccactaacattggctacctgttgttatccgggatcttagtatccctgctgtccgccgcaattgttggtttgtttgtttggtagaactaggagtgggaaccaacccgttcggcaggccgtttggctaagctagggcaaaggttggtgccatcagcagcgttctttgtccgtacttagacactaggcctgcggttggttgccacgttatctgtgtaacagccaagaaattagacaagaggttaggagaaaacgagtttttcccaacctcttttcttcccgctaaaataaaagcgttttcttaaattggaggaatgaacatgacgactaaaattattatggatactgacccaggaattgatgacgcagccgcactgacgatggcgatcaacgacccgagcctagacctgaagctgatcactacggtggctgggaacgtaaccgttgataagacgaccgccaacgccttaaagatcgttaacttctttggcaaaaacgaccaaatcccggtggccggcggggcggtggcgccgttaatcaagccgtttgaagacgcggcccgcattcacggggaatccgggatgccgggttacgacttcggcgatgactttggtcaaccgctagcaaagacggccgtcgaagccttgcgcgacgccatcatggcagaagatgaggtgaccctggtgccaaccggctcctacaccaacatcgccctgctcttctcccagtacccagaggtgaagtcccacatcaagcaaatcgtggcgatgggtggttccatctccggtgggaacatgacctcggccgccgagttcaacgtctttaccgacccggacgccgctaagatcatgtacaacgccggcgtaccgattgtgatggtcggcctggacgtgaccttaaaggccctcctaaccccagccagccaagagaagctcctggagatgggcgaagccggcaagatgcttcacgacctggtgacccactacaacgacggggacgaccaggacgggcacccgatgcacgacgttaacacgatcttctacctcctccacccggaggccttcacgaccaaggaaatgtggatcgacgtggtaacggatggcccggccattggggctacggttggtgacgttcgtggcgcctaccacgacggcaaggtcaacgctaaggtctgcgttgacatcgacgccgcggccttcaacaagtggttcttagaagaagtggcggcaatgaataagtaatagagtgggaaattcagagaattaataaaaagctgggagaaaagcacgcttttctcccagcttttttggcatcatttcccgggaaatgattcccgccagaaagccggagatcgcttgaaacaacgggcttattaaggtaaagtggtagggtaacgtggaacaagatgtttcacggaaaggaaaaagatatgaacccagaagaatttcgtcaagccctccttgaccacggcattgcgctgacggacgcccagatggcgcagtttgcgcgttactatcagctgctggttcaaaccaacgaacacttaaacctaacggcgattacggccgaaacagaagtttacctgaaacacttttacgattctttgaccggggccttcgcctaccctaagctccaaagccaagccctgactttgtgcgacattggggccggggcaggtttcccgtccttgccgctgaagatcgcctttccccagttggaagtcacgatcgttgattccctaaacaagcggatcaacttcttggccgacctgtgtgatgacctcggcttgaccggggtgcacctggttcacgaccgggccgaaacctttgcggccaaggggagtccgtaccgcgaacagttcgacttagtaaccgcccgggcggtggcccgcttggtggtgctcggcgagttgtgcctgccagcggccaaggtcggtggggcctttttggcttacaaggccagcgccgttaatgatgagttaaaattggcgaccggagcgattaacaagctgggtggccaggtggcggggacgaccaagttgaccctgccaaccaagccggaagcagaggagcgcaacctggtggtgatcgataaggtcgctaagacgccggggaagtatccgcggcgccccggggtacccgctaagaagccgctgattaacgtctagcaattgaggagtagtaaaatggcattttcattgtttaacattgggaagagcaaggagccggttaaaaaccaagtcgtggaggttccgctggcgcagatcgtgcccaatcgctaccaaccccgccaggtttttgaccaaacggcgatccaagaattagcccaaacgattgatgaacatgggctcttgcaaccgatcatcttacgcgaatacgaaattggtaagtacgaaatcattgccggggaacggcgcttccgggcgatgagcctgttggattggaccaaggccccggcgatcgtcgaaaagatgaacgaccaggaaacggcctccttggccctgatcgaaaacctgcaacgttcgcagttaagcccggtcgaagaggcccaggcttatcaacagttgatggaactcaacaagctgacccagtcggccctggccaaggggatggggaagagccagtcctttgtcgctaacaagttgcggctcttacaactgattacgccggtccaaaacgcaatcatggaccacaagatttccgagcgccacgggcgggccatgctcaggcttagcgaggaccaacaatgcgacatcttaatgaagattgttaataacggctggacggtccgccagaccgaagacgagatcgcccggatgcagggtaagccggtgccaagcgaagtggaggcccaaaagcaacgcgaactctttggcctcgacgaagagttaacggtcaaaaaagacgacgcgcaggatcaaccggctaaaaagaagaaggcgccgaagaaaaccaagaaggtggccagccgggtcaaggtatctgacccacggattgccgtcaacacgatcaaggaatccttgaagttagttaacgataacggctttgagaccaaggtcaaggaaaccaagaccgctaacggggtggagttgacgatcacgatcgttgccccgacggactagtgggggcgatgcaatgagtgatgcaaggcaactgaccgccccgcccggcccgggggaagtggttagggagttggcggtggattcaatccgccccaacccctaccagccccggcgcacctttgaccaggagggcttagcggagttggcccggtcaatcgaagcggcgggggtctttcagccaatcattgtccggcgcccggaccccaatttgaaccgctacgaattaattgccggggaacggcgcctgcgggcgaccaagatgactgaacgcaagacgattccggcgattgtccgggtcttagacgaccagacgatgatggaagtggcggtcctagagaacttgcaacgcgaggacctgagccccttagaagaggcccaggcctaccagaccttgattgaacgcttgaacctgacccaggcccaggtggcggcccgcttaggcaagagccgcccctacatcgcgaactacctgcgcttgttaggcttgcccgaagaggttaagcagatgctggccagtggcgagctatcgatgggccaggcccggaccctcctgggggtcaaggacgaacgacggctagttgaactagccaagcgggtcgcaaacgaggggctgaccgtccgtcagctagaagagatcgtggccgggattaacaagaaggggcgccaaaagccaatggttaaaagtgccaacccttacttacgagaggctgagagtcaactagcgggtaagttaggcactaaggttagctttcaggccaagcgccgcggcggcaagatcgtaatcccctatggttccaatcaggatttaaaccgaattttggaactgctaggggtgcactttgattagggggtagtaaagatggaagaatacgcattaaacgacattgtcgaaatgaaaaagccccacccgtgcggggtaaaccggtggcagattatccgggtcggcgccgacatcaaaattgagtgcaccggctgtggccacattgtcatgatgagccgctacaactttaacaagcggctcaagaaggtcttagaacgggccgaacaagaagaggattaaaggagtttttaaaccatgtcattaactgcagggatcgtggggttgcccaacgtcgggaagtcaaccctctttaacgcaattaccaaggcgggcgccgaaatggctaactacccgttcgcaacgattgaccccaacgtcgggatggtcgaagtgccggatagccgcctggcccggatcgatgaactgatcccggccaaaaagatcgtgccaaccacctttgaatttaccgacatcgccgggatcgtcaagggggcgtccaagggggaagggcttgggaacaagttcttggaaaacattcgccaaaccgacgccattgttcacgtggtgcgggcctttgatgacgatgacatcacccacgtcactgggaaggtcgatccggtcgacgacatcgacacgatcaacctggaactgatcatggccgacctcgactccgtgaacaaccgcttggccaaggtgcaacgggcggccaaggggcgcgacaaggacgccctggccgaactggcggtcctagaaaagcttaagccggtcttagaggcgggcaagccggcccggtcggtggaattcagcgccgaagaaatgccgatcgtcaaggggctcttcttattaaccattaagccggtcctgtacgtggctaacgtgtccgaagacgacatggccaacccagaggcttccaagtacatggacgtgatcaaagaacacgtggcgggcgatggtgaagtgattgggatcgccgccgccgccgaagaacagatcgccgaaatggacgaagaagaaaaggccgacttcctggaaatggaaggggtagaagaaccaggattaaaccgcctgattcgggccgcttaccagctcttgggcctggaaaccttcttcaccgccgggggcaaggaaacgcgcgcctggaccttccggaagggcactaaggccccgcaggccgccgggattatccactccgactttgaacggggctttatccgcgctgaggtcatgtcgtttgaagaccttgaccagtacgggagccacgccgccgttaaggaagccggcaagctgcgcctggaaggtaaagactacgtgatgcaagacggcgacattgttgaattccgcttcaacgtctagtcaggatagagaatcgattgagaggacaccaccgtgagtgaacaggaacaaaaaaacgccgctgccggacaacgccagcgccaacacctaaaagaagaccggcaaaagaccgggatgatgtttgaaaacgccgggttgacccgtaagaatgaagacttcatgtaccagttaaataagcaactggacgcccagggagcgacggccgaagccaagacggccctgttagaagaaaccatgaccgccctcttggaaggtcaaaagacggggcaaaccgcgaagggactgtttggaacgcccaccaagtacgccgatgaactcctgcacccgaagaagacgccagccgaacaacaacagacctcgaccgtcttaatgtcggtagataacgggctgatgtttttcgccatcttcaccttcatgtttgggctgatggggttgatgcaaccgtcaactctgaagctggcccaacgcgggagcgccgggctggtcgcaatcatcttggtcgccgtggccggtggggcggccttcgggttcgtcaacaagattttgttgccaacggtcgatgaaaacgggaaacaacaccgccggccgttatggctccggattgtcctggtgttaggggcggtggtagcctggattctggtctacatgctagtggccttcttgccaaacgccatcaacccagtcttaaacgcctgggcttacctaatccttggggtagcgtccttcttcggcgacgtctacttccgccaacgctaccacattgtcgggggcttctggggctcgtcggccaaccggcggcgccgttaagaaagtggcaaataacctacccgcagggtcgccacgttttctgtctaacatttaaaatacgccagaggctgggaaaagttctgttttcccagcctctttttacgttctaaaaccgaacgttattcggggagcttcggcagggagttctagaatttgggcaaaaaagatgagaatcgggttagaaatgccggaaatgattgaccaaagccgatatatcgagtaaagtactaacaatataaatttttccaaaggagtgctgttcaaagatgtcaaactgggataccaagttcgccaagaaggggctaacttttgatgatgtgctgttgattccggctgaaagccacgtgttaccaaacgaggttgacctgtccacgcagatcgccaagaacctgaagctaaaggtgccgtttatctccgctgggatggacacggtgaccgaatcatcgatggcgatcgccatggccctgcaaggggggatgggggtcatccacaagaacatgtcgattcaggcccaggctggtgaagtggccaacgtgaagagcgtcgccctgaactcgatgatgagccacgccgccgtcgacgaccaaaaccgcctgctggtggccgctgccgttggggtaacgtctgacacctttgaacgcgccgaagccctgtttaaggccggcgccgatgcgatcgtaatcgacacggcccatggtcactccgccggggtgctgcgtaagatcgccgaaatccgcgatcacttcccgaacgaaaccttgatcgccgggaacgtcgccactggcgaggggacccgggccatatttgaagccggggttgacgtagttaaggtcgggatcggccctggttcgatctgcaccacccgggtggtggccggggttggggtaccacaaatcaccgcgatttacgatgcggctagcgtggcccacgagtttggtaaggccatcatcgccgacggtgggattaagtactccggtgacattgtgaaggccctggccgctggtgggaacgcggtcatgctcggttcgatgttatctgggacgaccgaagcgccgggtgaagtttacgaagataacggtaggaagtacaagtcttaccgggggatgggctccgtgggggcgatggcccaatcccatggttcttcggatcgttacttccagggaggagttaacgaagctaacaagctggttccggaagggattgaagcacgggttgaatacaagggggacgtcagcgatgtcatcttccaaatggtcggcggactacgctcagggatgggctacgttggggccggcgatattcaaaccttaatcaaccaagcccaattcgttcaaattacgaacgccgggctgcgggaatcccacccacatgacgttcaaattaccaaggaagcgccaaactacaagtaaggcggttgaaaaaggaaatgcgtcgcccccaggtgtgggggtggcgcatttttagttgacaaaaaaatcataaaaactccaattttatcaaatgataaaaagtagtcacattaccatgtacttattaatatattatctatacacatagtaaaacgttgtcattttactaaggtgaaactcataatgaaacggctttcggttgatgtaaccaagtaattatttttatttaaaataacacttgtaatcgaaatgtgactaaattatagttgaatacaaaattaaaacgtagcaaaataggttaaagattgattaatattgtccatagaagggcaaaaaaaggaaggtcagcatggactctgaagaattacaacaccgttcttctcagcaccaccatcataaccaccatcaccggcgtcgctggctgcggtggttatggatcctcgtggggctagttgttgtcgtagcgctcttctttgctggaatggcttggcgaaacgttcgcgttgccaccaacagtatgtattccccgagcggggtggttaagagccggaacttaagtaagttattagctgctaagaaaccaattaacatcctcttactcgggaccgatacgggggccttggggcggagttataagggacggaccgacacgatcatgatgatgtcggtcaacccgcaaactaagaagacgacgatcgtcagcattccccgcgatatggaagtgaccctgcctgattacagcgatgagtcaccggccaagctcaacgccgcctacacttacggcggggtcaaggaaacgatcaagaccctcaaggaatactacaacgtaccgattgatggttacgtgctcgtgaatatgggggggctagaaaaggcgatcaaccaagtgggcggggtaaccattaagtcaccgctgacctttagctacgggggttactcctttgaaaagggaaagacctacacgatgaagggggcccaggccctggccttctcgcggatgcgccacgaagatcctaacggcgattacggccgtcaggaacgtcaacggctcgtaattatggccctcttaaagaagtcggcttcctataagtcaatcttaaaccagtcgttcttaaacgacattgcggacgaaacgcaaaccgacttcaccctgaataatatgatgagtgtcgccctccactaccggagcgccagccaaagcgtcacttccgaccacgctcagggaacttcccagaccgttagtggggatgattttgaagtagtctcgacgaccgaacgccaacgggtaagcaacgaactacggaccaccctgggcctcaaacaagtaacagttaagatggagagtaattaatggaaagcgaaaagaataccaacgcaattgacttgcagcacctctggaagctgtttgttcaacacgtgcgcatgattttaatctggacggtgggcctcggcgtcatcgcttgggggatagctgcctttgtgatcccggctaagtacaccgcgaccacccaaatcctggttaaccaacgcaatagcaatgacaataacggtcaggcctataacaaccagcaggccgacattcagatgatcaatacttataagaacatcatcaccaatcaagtgatcctaaagagtgcttccaagcagttggccaacccgagcgggagccaacgggcctacgcattaagcgtggataagctgaagggtttactgacggtaagcacccaaaacaattctcaagtcttctccctaagtgcggaggcgggcaacccgacggaggcaaaggtgatcgctaacacggtggccaaggtctttaagaagcagattcgttcgatgatgaacgttaacaacgtgacgatcgtctcagaggcaacgacgccaaccagccagtccttcccgaacaagaagctctttgccttagctgggctagtgctcgggttcttgatcagctacgtttacgtactgattcgtgacttaaccgacacgacggttcgtgacaacgactttatgaccaacgaactgggcttaactaacttgggtcaagttggtgaaattcacatgccagccgactttgaatttaagccgttcgatgaccaggctgctggtcaccgccgggtctagaagggaggacttttaaatggggttatttaaataccggtataccaaatccaacgacacgatgaataacggggtcatgctaatcatgctggccgacccgaagagcggcccggccgaacagttccggacgatccggaccaacattcacttcatgagcgttgaccggccgctaaagacgtttgcctttacctcctcgggaatctcggaagggaagtccacggtaacggccaacgtggcaatcgcctgggcccaagaaggtaagcgggtcctcttgatcgatgccgacttgcgccggtcgactctacacgcgacctttggcctaagcaaccaaaaggggttaaccaccattttgactggggacagtaaagaagtcgaccttagcaacgtggtgcaaaagagcggggttgaaaacctggaggtcttaacggccggtccagtaccaccgaacccatcggagctgttgggttctcagcggatgcaatcgctgattaacggggtgcgggaagcctacgacatagtggtcttagacgtgccgccgatgctgcaagtaaccgacactcaagttctatccagcaatctggacggggtaattttggtggttcgccagggtatgaccaaaaaggcagccattcgccgggcggtggaaatgttgaagatttcccaggccaacgtcttagggtacgtgatgaacgacgtttacgatgacgacgctggttacggttatggctacggctatgactacgagggaggcgaaggataagttaaacggaaagggggacttcttcgatggggctaattgatttgcactgccacctgttgccggggcttgatgatgggtcaccgagcatggaaacgtctttgaagttagcacaagaagcggtggccgatggggttagccactgcttgttgacgccgcaccatttaaatggtcactacgtcaaccacaagcaagacgtgattaaggcaacggcagattttaaagaagcccttgaagaagctcagattcccctgaccgtttttccgggccaagaagtgcgggtgagcgatcgggttttgccggcactagaagccgacgacttgttgtacgtggacgaagaaggccgctatctcttgttagaaatgccaagtggtggggtgccgacctttgctcggcagttggtctttgaactcttacaacacggggtgacgccggtaattgtccacccggaacgcaacgccgccattttggatgatccaagtattctggaggcgtttttggaacagggctgtttaacccagctaacggcggcttcttacatgggcacctttggcaagaagattgaagatttaacgacccggctaattgaagcggggcaggggacgatcttcgcatcggacgctcacgccctagcccggcgcgaccacgagttaaacgagggactagcaaaaatggcccgtgagtttgatccgcacttggctgagcattaccgccgcaatgccaagcagttaattaacggtgagccagttcggatgaagtggcaaccactgaagaagaaacgtaggttttggttattttagtaaaacaggaatcatggaggacaatatcttatggtaaaagcacttgtcactggaggggcgggatttattggatccaatctagtaatctcgttagttgaaaaaggatatcaagtgaccgtagttgatgacctatccatgggagtgaaggctaacttagctacggttgcagatcaagttgagttccatgaacatgacgtgtgcgaccatgaatttatgcactccattcttgatgaagactttgactacatttactatttagctgcgattgctagtgtagctgattcggtggaacggccgtatgaaacgcaccaggtgaaccaagaatcagtggtagatacgttggaatacctacgggtaaagggatatcaaccaaagaaattcctgtttacctcctcggcagcggtatacggtaactatccggaattaccgaagcgagaagacagccgagtgcaaccattaacaccatacgcagtagataagtatgcttcggaacgatttacaattgattatggtgacttatacggattatcaaccgtggccgtccgattcttcaatgtgtttggtccccggcaaaaccctaattcaccgtattctggtgtactatcgattgtgacgaactgtctgttaaaggatcagcagtttactctgtacggggatgggagtcagacgcgggactttatctacgttaaagacattgttaacgcgttgattttcattagtgaggcaacaaatagttatggggtttataacattggttacgggaagaaacacgcattgctagacgtaatcaggatgtttgaagaagcggccgggaaaaagttgaagattcaatttgcggaagcacgaaatggggacattcaggaatctttggcagatattacccgtttaaaggaattaggttttaaagcaaattgggggttagaaaatggacttagggaatactgggaatatgcagatggaaaaagtaaatagtaaggcgcaaatagcaggaaccacctacgaatacttagaccacattggcgaaccaatcccaatgaagaaaatggtgtggaaacgattttgggatatcatttttggcttaattgggttaatcatcagtatcccgttcatttttattcttgggatcattattaaattaacatcgaagggaccgatcttttttaagcaagaacgggttggctacatgggaaagacctttgatgttatcaagctacggtcaatgcgaaacgatgcagaagctaaaaccggggctgtgtgggctcaaaagaatgacccacgcgtaaccgcagtgggtcggtttatgcgaaagacgcggatcgatgaactaccacagttttggaattgtttaaagggcgacatgagtatgattggaccacgcccggaacggccagagttaacggaaaagttctataaacagtggccggaattcccgcaacgcttgcggattatcccaggaattactgggtatgcccaagtaaatgggggctatgatatttccccagaagaaaagtgtcacctagataattactatattgaaaactactcatttacctttgacgttaaaatcgctttggagacgatcaagacgatgttcacgggtgatggggcagatggggcacgataaaaaagaatagatttgaagaaaacaggaagtagttttatgagtaacgataaatttcctgctttttctgtattattgtcggtttacaaggatgaagaaccggcatttttagatcaagcattagagagtatcgaggatcaaactgttaaaccaaatcaaattgtggctgttgtggatggccccatagggagtgaactcgacgctgtccttaaagaacatcaaaatcaaaatacagatatctatacaattgtacgttcaccaaagaatcaaggactaggattagcactacgaatggggacggagtactgtaagtacgattggattgctcgaatggattcggatgatgtttctgtgccaaatcgatttgaattacaattaaaggcagttgttaataatccacagttagcaattgtgggtggtcaaattgatgaattcacgggtgaagttaatcatattactggtaaaagattggtaccaacgggtcaagaagacatctaccaatttgtaaaatggagaagcccatttaaccacccctcggtaatgttaaataagaaagctatccttgatgttggtaactatcaagcgaatgggaagctagaggactacttcttatggtctaaagttattattgaaaagtatccagtattaaacttatcggaagtattagttcatatgcgtgttgatacaggaatgtacggacgacgcggggagtgggctaacttaaagcaaatttttaaattacgtcgaatgttgtacagaggaaagcttgtttctaggcgcgaagagttaacgggggactttgtaatggtggcaaatgttatcgtgccagcaaagttacgggagttaatttataaaaaggtactacacaagtagccgaatcattagaaagccaaagaaaatagggataatgagatatgaaaattggaattttaacttactacggtgtgcataaccacggggcagtgttacaagcaaatgcgctaaagtctctatttaaattgtctattttattgacaggggaccagtttcggcttggctggatttgaagatcttcttcaagacgatagttgacgttatttgtggacgtggaatacatgaaggaaaaaatgaaaaaataagaatgtggttttaaatgtcattattaaaaataatatccgcccttttcggtcttaatgtcagtttatgaaaaagaaaagccagattattttgacttggctttaaggagtatttatgagcaaacggtaaagccagatgaaattattttagttgaagatgggccaattcctgaatccttgaaaaatattgtaaaaaagtatcaggcgttatacggaaaagaaaaatttaaggttattgtttcctataaaaaccagggtttgggtgtatcactgaaactaggaacagaatttgtttcaaatgagtggattgcccggatggactctgatgattatagcgttcctaataggtttgaaaaccaattagaagctattagcaagcaccctgatgttgacgtagtaggaggacaagttaaggaatttgaaactgagattggcaatattgtcagtcaaaggaaagtgctggttgatgaggaagctattcatgaatttatgaagtggcgcagtccctttaatcatcctactgttatgatcaataagacaaaattacttgaagttggtgctatattccgtatggcaatttggaagattattatctgtgggcccgaatggttgccaataactattctgtaatgaatgtcccagattacctggtttatatgcgcgctgatgggggaatgtatgcccgacatggtaaattaaaaaatttgaaatatttttataagctaagaggctatttaaaacagaaaaaaatactctcatctagtcaagctttttgtggagacataatgatgactataaatattgctttgccagtctttttacggaaaaagatttatcagaactggttgcataaataatcaggaattgtaggtttactcatgaataaaagaaaaaatttatataatttatttattgattatatgcttggctttttgatagtttttactatattaagctacacagaaaatctagtcggaagttcgatattaaaatttatacctgggtttattattattctttctactatcggaaagattgattttaatgcatataaatgggttggatggttatttttaatagtaggagtaatgccattaatattaattattttgggcgtttataattatgatactgggcaatcgatagcatatatttttttgtttagctattatcttgtattaataatatgtctagctgaattttatagtaataaattagttagtttcattactatctggcaggtttctattacacttgtattagcagggctatttgttatttatcggggaataagcctaaacttgagctatttattatcccttacgatttcaaatcagcgatatggacaatacttattggtacagcgttatggtatgggctttaggaatgttaacactttagcgatggtttcaatgcttttaattttttgtagcgtttttaatttaataaagagtagattaaaagctttatcaataattgatattgctgcttcaattatttttatattaaatgctgaaagccgaacaccgtttattgtaatgtttgtacttttgatttgctatttgatttcaagggtgaagaacaatgcaaggagaatatttgtagaaaacctagtctttatttttgaagtaattatagcgatttgttttacttttatttttgtaaatgattcacaatcaagcttttacaatgccattgatgaaatttcatcgtatcgtttatcttttggcacttcagcatttattcttcttaaaaatataggaaatatatttctaggacttggtccgttgaatagttcctatataactaaaacagtttttggtaacactttaacactagataattcaattgaatactatgtttttactttaggcttgttaggatttgcattggtatatatatatttattttatttattttttatagtaaataagtcaggaagcaagttcggatttataactactactttctactttgtatattctttttttgagaatacaatttttttacctatttctaccatttcattactttgtttaactattatttttattacggtgaggaattatgaagagaatggaacagcaaaaattaattacaatagtcactattacttataacagaaaagataagatagaaagactttacaaatccttattagcacaaaatgattatgatttttgttgggtggtcgttgatgatggaagcagtgattctacagctaattatgtgaatagtttgattgcaagacattctaataacaatacctttccaatcaccttgtatcaaaatgacaacgttggcaagtataaagaaatcaattttgtactctcaaaaatcaagaccaagttaatgttttttttagatagtgatgattatttggtgaaaaatggtatcaaattaattaagcattactggtttaagcggccaaatttaaatattggttcaataatttttgaaacaggttatgcaagtagcataattccaataaaaagaatagctagtgaacatgtttcaagaagatattattatcttgtcgaacataaagtttatggagattatagtgatgtctttgttacagaaagaatcgtcgattttaggtttcctgaatatgggaacgaaaaatttatgacagagggtccactgtattatgagttttcaaagaaaaataactcattatttgttccaaagattttgacaattggttcgtatttagatagtggattaaccaaaaatattagaaaaaaccaggtaaaaaactatcaggggactttgtatgaaactaatctttatctaaataaagatactcctcttttttttagaataaagaaaggaattttatacgattatgtattattgaattgccccttaaaaacattagatactttaattaaaagtaaacatttattgcttcttagtagttgtttaccgctagcgtttttattaattaagttaaataaaaaataaatgcccggatttaaaatctaagtgcaacaagttcaaattatacaaataggccatggagacctaaacttaaagtgctgaaactctaaagaaaggacatctccatgacccaatccaagcatagcactaccaaacattatcaacaacttaccccggaagaaagaggtgaaattgaagcgtacttgaatgctggaaaatctcaggctgatattgcgcgcctgaccaatcgcagtcgcagcacgatctcgcgtgaaattaagcgtggcaccattcgacaacgtaattctgactatctctttttcaccaaatactttgcggacacgagccagcttattcatgataaagcgcgtcagaactgccgttttggcggactagaaaaggtctgctggttgttctttaagatgcttaaaacagcgcttaaacggcgaccacggattgatagtgttgatggtttcgtgcacgcctttaagcagactcatcctgaccagccgtgcccttcaacgccgaccgtttatcggtatattgatcaaggccgcttagacattaagaatatcgacctgccagccaagctgcggcgccatgtaaagtccaatcgtcacaaccactcgcgtaaaaataagcgtctggctggtacttcgattgatgaacgaccagacactattaataaccgtgaacgctttggtgattgggaaggtgacctggttaaaggcaagcgtcaagccagtgaaccagcactgatgaccctgaccgaacggcgagtccgctatgagatcatcgtcaagattcccaactaccacgcagacacctgcttaaaagagcttcaagccaccattgaccagcatcctggctactttaagaccatcactttcgataacggctctgagttcaaactgttggaccaggttcaaggagctcagatctactttgcgcacccgtactcgccttgggaacgtggcagtaatgaaaaccagaatggcctgatccgagagtacatccctaaaggcctatcactacatggcttctctgaagatgatatcgcaaaggttcaagatgcgctgaatcaaaaacatcgcaggacactcggctacgctaacgccgccgagcttattgaggccgcgctagcaagctagctcacggtctggctccatggtgttgcgcttgagttgacattccgggagtttgtttaataatagaaataggacaaaaatctttagggaagaatgtaatgaaatagctgcaaatgatgactgggcctagaataaaaagtgtacaagttaaatagagactctgatttagtataattaaggaagtaaattggaggatcaaataatgacgaagcacagttatgacaaggaatttaaggaacaggccgttcagtattacttagataacaaggatcacatgaccatgaatgaaataagtaagaatctaggtattggggctagtacattacataaatggattaagctgtttactgagactggggagtttggccgtggctctggtaattttgccagcgataaggacaaggagattgcacgactaaagcgtcaacttcgtgacgctgaaggagcgatcgaagtattaaaaaaatcaatcgggattctgagcaagtaactaccgaaaaggtataccaagaaatggacgttcagcacgctttggaatcccacccttccatcaatggtatgtgtgattatgttggaatctcaagaagtggttactatcaacgagaaaagcgtcataatcaccaatcaccgcgaaagcttcggaagaagtttattcaaggtgaaattaaagcaatttggctcaaaagcctttgtatttacggtgccggcaaaatcacccaagaacttcgctcaaaaggatataagatcgctgaacgaactgttggtaagtatatgcgtgaacttggcattcacgccgtttacctaaccccttggacgactaccactcgcaattctaagtttgataaacagctaataaatattttagacgagcagttcaatccattgcaaccaaacgccgtttggtgcattgacaccacttatattccagttcatgacggattcgtttatttaaccagtattatggacttgtactcccgacggatcattggttgggacttatctgaaaccttggaggtatcgaatgtcatcccacttattgaaaaggctaagcacagtcgccatattagcaagccattaatcatgcacagtgatcgtggtagtcagtttacgtctgaagcttacaatcaagttacagctaacatgacattaagctattcaaagaaagcttatccttgggataatgcctgcattgagtcgtttcatgccttgattaagcgtgaatggataaatcggtttaaaatccattcatactccgaagctaaacgactagtttttcagtacattgaaacgttttacaacacagttagaattcacagtcactgtggattcaaatcaccaaagcaacttgaagatgagtatcaaactcaaattcaaaatttagtcgtggcataggacaaaaaagtctctatttaaattgtctattttattgacaggggaccagactttaaatacctaagcctattaaagtcaaaaagggtatcagacttaattatagtaatcttatttaaaatgaagttacatttatttcttcaactattatataaaagaatgtatcgatagaacattttgagcgaattaagaatagaaggattaaagggaatggaaaagggtactttattaactaggaaacaaatacagcatgaactatgtttaatgttagagaaaatagataagttccttgaacaaaataacatacgatactcgataatgagtggtaccatgctgggagctgtgagacataggggctttattccttgggatgatgatacagatattggtatcttacgagctgactatgatcggctagtaaagattttaaaagatcagaatgagatatcgggtaatctttcgggaataggatttgagataaacagcaatgatttttggccattcataaaaataatcaacaaggatattttagtgaaggaggatggaatatccaggaaagaaaatctatgggtagacattttcgcttttgatgagatgcctaccaaatttttggattttcgatttaaagaacatgtttttttaagaaagatattaatgcataaatcgattgcagatggatttcacagtgatggatttcacagtaattgtaataaaggcttgaagaagaatgtatggctactattagaaaagttcgtagatagggtagaaaagttcgtagatagggaaaagttaactaggttatatattgataggtgtactaaatataattttagaaaaaacgatcttgtgaatgactggacctggggtggaagaactacttctacagtttcacgtaccttgtttgatgatctaacagagtatcaatttgaagacgtagttgtaaaagggtttagagattacgatacatacttaaaacgtatatatggcaactatatggaattgccaccggaagaccaaagagttaatcacaacgttgtggcatggaaagtgaagaatagtgaagaataaagttaccttactgaatatggtatcaggtttagtcctacagtttattacggcgattagtggttttattttaccaaagattattctcatgtattttggctcggaagcaaatgggttagtttcgtcactgactcaattccttagctatataaatctagtagaaggtggagtcacaggcgtcattgcggccaacctatacaaacctttggtggaacggaatattagtaaagtatcggctatattagtaacctccaataaattttatagaaaaataggcacagtatatatcgcatatacagtcgtgcttgctactagctatccgctaatcttccataccgaattttcgttttcttatatttttgccttaaccttaattttgtcattaggtcttcttattcagtatatattttcaatatcgcttaagaccttattaaataccgataaaaagacatatattgttaattttactcaatcggttattgtgatacttaacctagttctatcagtaatttcaatccatgtttatcctagtatccatatttttaaattaattaatggtattttatttgtacttcagccattagtatttggtgcatatatcaagaaaaactactctattaattggaaagctaaatccaacaatgaattaattaaggaacgttgggacggattcactattaatttagcagcgttcatacatggaagtacagatgttacagttttgactatttttacaaatttaaaaattgtttctgtatataacgtatattcacttgttttgatgtcagttaatcaattgataaatgccattatagccggtattacggcaacggtggggcatgcttatgtaagaagagacttcaaagaattaaatcaaaagttggacatttatgagtatgttgtctttatactggtgttcttcatttttacagttactgccttattaataaccccgtttgtacagatctacacacatggtgttaaggatgctaattactatcagccaacgtttggccttttctttgtgattgctgaagctatctatatggtaaaaatgccacatttaaatttagcttatgctgctaatagatttaaggaaattactttacctgcttttattgaggctggattgaatatagtattgtccattatttttgtaagggaatatggacttgttggtgtagcaatcggcactagcattgcaatgacgtatagaatggctttccatgtatactatactagtaagattgttccaggtagggtgcaaagtattttctataagaaactgttgatctttacgggtacatcaattgtagggtatctattgtgtagcgtagttcttccattgacgaagctgagtgttgttaattggattctgtatgcattgtactattcaattattgtagggattctattaggccttgtcagcctagtgtttttcaaagaggaactatcattttttagaaagtatttaaaaaactagaggttaagattctatcataggctgataataacattgggggtagtaggacatgaagcatgccataatggttatagggtatggggaaaacgcaggcgttttacaggaaacaataaatgttttggatgatagcgatatcgatttctatattcactgggataagaggtggccattgccaaaacttactagtcaatactctaaagttaaactagttggtaagagaatagcagtaaaatggggaagttttacgcaggttgaagcagaaaaacatctaatgcaggtcgttggatcatcgtatgattatattcatttgatatccgcaatggatatgccattaatgacggcaacttattttaagcgatattttacaaatgatgtttatgttggattttctgatccagaaggatttgagtatcgcttagaaggatattatccaaatcatgtagactttagaaaacatagactgacttttaagctatatcgattatttaatcgtttttttaaagttaatcgtcttaaggacaatacgggattttgtgttcataaaggtccacagtggttctcaattaaagggaagtattcactagagctacttaactctgatttgtcgatgtttgaacatagttgtttcccagatgaagagtatgtgcagagtatattgggacgattcgatactggagattacagtgaggatgataatgcccaagccgcacgctatattgattggcatcgtggtggaccatatgtttttacagataaagatataccagaattaaaacagctggttaatacggactacgcatttgcaagaaaagttaaagactccaaaattatagaattagtttacaataccatgagtaattagtatgaaggggaaaaaatgaagaatagggtttcgtggtgggatataagcaagtataggaatcagttgttttcaattgcgataataacaatatacatccatcattttttcgaaaattcaaaatttcatattgccacgggaatatggaataaggttcttggagcggatggtgtagaaatattcttattcttgtcaggaatggggctgtgcttttcgctgaatcgaaagtatgatctacgacagttttatattaagaggtttaagcggatccttccgacatatctcattgttggagtaataacttggggattgatagatttcgttttctttaacaaaccaaattcctttattgaagatttatttttcatcacttttattactgaggggaatagattatattggttcatcttgtttattctggttatgtatctagtttatccatatatttatggacgattacgttgggagaatgaacatagggaatggaactttatctttttcttgctgattagcgtagctattaatacgtttgtttcgatgtttgatccaggcttgtataacaatatcggcatcgcaattaatcgaatgaccgtatttttggtcggttcttattatggagagaagatttttcataaatgcagtgtgaaaaagtttgatctaggtattgtgattttaggggcaattttaaaggcagtaatcatatttacgaatcattttaaactcctttttttgccacaatatttggtagatacctcctatactttcaccctactatttatcgttatctatgttcttaaatttctagataaactgatttcaacaaaatggttagcgcgatttggtaagtattcattagagctgtacttgctcaacgtatcgcttcgacgaatatttgactatgtaggtttctcgacgagcatactattaaactatgtagtgcttaccatcattgccatagtactgagtatactattacataacgtagttgaatgggggatgaatagattatcatgaagacagcagtgatttttgcaggtggagtgggaacacggatgcactcgaaagatattccaaagcaatttttgaaactccacgataaacccattattgtgcatacactgggactttttgaagaaagtccagagatcgataatatagttgtagcatgcttagctgattatattgattacttacaaaagctggtggaacagtataacttaaagaaggttaaaaagattgttcctggtggtaatagtggtcaagaatcaatctataatggtttgaaagcagcggaagaagttgggaatcgtgaggaggacattgtcttgattcatgatggtgttcgaccgttgatcaatgaaaagacgattcaagataacattaagagtgtccaagaacatggctctgcaattacgagtgtgaaagctaaagagacaattttagttgttgatgatgaagaatccattgactcagtgccagatcggtcacattcacgattagcaagggcgcctcaaagtttctatctgaatgacattttaagtgctcacgaacgggcaattgaagagaataagtatgatttcatcgactcgtgctcaatgatgacatactatggtcatcgcctatatttagtagacggtccgcaagaaaacattaaaattacgactccagatgatttctatacgatgcgcgcactattagatgcaagagaagacgcacagatttatggattagaggattaaaatggaatcaaacggcctcacaagagattttgaagaactcttaagtagtgaattaaacattagtgagtttaaagacaagagctttttaattactggtgcgacaggtttagtaggctcaattttgattaagttccttttatatgctaatgaaaaattaaacctgaatgcatccgtgtatgcattggttcgcaacattgaaaaagcggataagatatatcaaggatatgacacagctaatttgaaatacgttgtggctaacctaggtcagaataatctcaaactagacgctgagcttgattttataattcacttagcatccgtaacggcgtcgaaacagatggtgtctaagccggtagaaacgataaagacggcagtgaatggaacagaagagattctaaaccttgcagttgaaaagaaagtaaagtcagccgtttatgtttcttcaatggaagtctatgggcaaccggaggaaagccaaaaaactacagaggcagacctaggatacgtggatctaacttctagtcgatcaagttatcctgaaagtaagcgaatgtgtgaattgctgtgtaccgcatacagcgatgagtatggcttaaatgtaaagaccgctcgattagcacaaacatttggagcaggggtattaccttcagaaaaccgtgtctttgcacaatttgcgcgaagtgtgattaacggtgaagacattgtactaaagacggaaggaaagtcagaagggaactacatctacactgcagatgcaatcaaagcgctgctgtttttactactcaacggtgaggcaaagcaggcgtacaatgtttccaatgaaagtaaccacatgaccatccgagaaatggcggaaatggttagtgctaactttggcgatgagggtcaaaaggtagtcatcgatattccaaaggaagacatggggtatgctcctgaggttcacatgtggttggacaattctaaactaaaatcattgggttggcagccaacgattgacatgaaagaagcctatgcaaggttgattgattggttgaagagtagcgataaaaaagaatcatagtaaagcggtactgtatcctgtcaagttgacacattaaataataaaaactagttggccttgccgaagcggtattctgctgcggtaaggtcatttcttttgcctgaaataaaggaatgcgtaaagtaatcgataccttctgtcaccagctgttataagtcttcaaacgtttgtggttgtggtgagcgtacaatagccttaaaagttgtcactttaagaaataaaaagtgatgacttttgaggctatttttagggagtgtaaaatattttgtgtaaattgataccttgagggtattgaaaaagggaaagccttccccgtatgattgaaatcgccaaaaaccaatcagaatacggaggctttccccatgaaccagtttaacaaagatattatcgcagcgctatcttccgacaaagatattaccctgaatgaagtcttacgtcgtcaaatcgaagtggccgctaatcagttccttcaaaatgaactgactgcggtgctaggctacgaactacatactcggatcgaccgatcaaaagacgacgtgaactaccggaacgggacgtacacccgcacgatcgacactgagtacggtgaaattaatctgacgatcccacgggaccggttaaacaagtttcaaaacgccctcttccctccttacgtgcgtcggactgatggactggaggaaatggtcatcaagatgtactccaagggcgtcacaactcgtgaaatcgctgatatggttgagagaatgtacggccactactactcaccaaccacggtttcaaacatcactaagcggacggaacacctggttgaagagttccacgagcgcaaattcaagtactcacagtacgtctgtgtgttcctcgatgctacttacattccgttacgccgtggtaccgttgaacgagaagccgttaacgtagcgatcggaattcgaagtgacggcggtaaggaagttcttgactacagtatcgcaccgaccgagaacggagccgcttggtctgaactactccagggattacgcgcacgggggattaaagatattcagttgtttatcgccgacggtttagttggacttcaatctgcgattgaggctaactacccgcaggcaaagtttcaacggtgctgggtccacgcagagcgcaaccttttagggtacgttcgcaaaaacgatcgcagggagattatcaccgactttaaggctattcggcaagcagagaacctacaagccgccaaagaacgattggcggctttcagtgctaagtgggagtccagttataagcgtcgaatcaagaatctagtccaaatggaggagctattcacgttcttcagttttccaactgcgatccgtcagaccatctactcgacgaacctaattgagtcgttcaataagagcctgaagaagatggtccgacgtaaggagcagttcccaaacgaaggggccctcgatcgctttatcatgatgcaagtgatggagtacaacgataaatttgagaatcgagcacatcggggattcaaggactgtcacgacacgcttgattcgatgttttagaatcgccaattcatgcgggcgaagtttccttttttacacaacattcttgacactctcttcagtattacttagataacaaggatcacatgaccatgaatgaaataagtaagaatctaggtattggggctagtacattacataaataagctgtttactgagactggggagtttggccgtggctccggtaattttgccagcgataaggacaaggagattgcacgactaaagcgtcaacttcgtgacgctgaaggagcgatcgaagtattaaaaaaatcaatcgggattctgagcaagtaactaccgaaaaggtataccaagaaatggacgttcagcacgctttggaatcccacccttccatcaatggtatgtgtgattatgttggaatctcaagaagtggttactatcaacgagaaaagcgtcataatcaccaatcaccgcgaaagcttcggaagaagtttattcaaggtgaaattaaagtaatttggctcaaaagcctttgtatttacggtgccggcaaaatcacccaagaacttcgctcaaaaggatataagatcgctgaacgaactgttggtaagtatatgcgtgaacttggcattcacgccgtttacctaaccccttggacgactaccactcgcaattctaagtttgataaacagctaataaatattttagacgagcagttcaatccattgcgaccaaacgccgtttggtgcattgacaccacttatattccagttcatgacggattcgtttatttaaccagtattatggacttgtactcccgacggatcattggttgggacttatctgaaaccttggaggtatcgaatgtcatcccacttattgaaaagactaagcacagtcgccatattagcaagccattaatcatgcacagtgatcgtggtagtcagtttacgtctgaagcttacaatcaagttacagctaacatgacattaagctattcaaagaaagcttatccttgggataatgcctgcattgagtcgtttcatgccttgattaagcgtgaatggataaatcggtttaaaatccattcatactccgaagctaaacgactagtttttcagtacattgaaacgttttacaacacagttagaattcacagtcactgtggattcaaatcaccaaagcaacttgaagatgagtatcaaactcaaattcaaaatttagtcgtggcataagacaaaaaagtctctatttaaattgtctgttttattgacaggggaccaccgagctgcgggaatcagtcggtaagcgtattacaaatggttaaattgtagattatcgctacgcgaacagtaggaacgggaagtactagaggagatcaagcgaatcgaaaaacggcatcaagatagtgttgtatacgataagatggttcgtctattgaataaagagggccgattaagttacagagtggggattaagcgggttagcaggattatgaaaattaatggaattcgggcggattaccggcagccaaaaaaggaccaccagggagcaaaacaaacctatcaagatgaaaacctactaaatcggcaatttaagcaagaaaagcctaatcaggtttgggtaacagatacaacagaactgacttacgggaccgctaataaagtccgtctacacgccatcttagatctatatggacaacggccagcagcatggttaatctcaccaacggagaccagagaagccgcaatcaaagtctttaaccaagccgctaaggctagtggaaccactccagaaatgatccgtacggatcgtggagcggcatatacgtccaccaattacaacgaagctttccgtcaggagaaggtaaggcatagccgatcggtgcctgggacaccagcggataacgccgtaatggaacactggtgggcagattttaaaagcatctggctcgagcatcgtccaaaggcgcaaactctagcagagttacaggaacaggttcgtgctggaataatgtacttcacgaatcagttcatttccgctaaaagaaatgaccaaaccgtggcggaatattaccacgatttggttggataagaaaaattgtgtttttgtttttataagtgtcaacttgacaggggatagtaccccccctagagatgacacttttattatttaaagtgtcatctctagggggtattgtacgtggaatgcaggaggggcgttgccatttcatccgttaaaaatccggtagtttctcgtaagcgaggcgcttgatgaccgctttttggtccgggtacttagccaggaggttggcttgggtgaagagttcgaagtcgtggtaatcaaagccgggggccacggcgcaagagactaggccaaaggaagcgggatcggcaacttcggaaccaaagatcgtgccggccgggacccggaactggagcaactcaccggctgcgacgtcgcggccgagcttaaccacctcgtaaaagccgttggggtaaaagcagtggaccaagattggtgccccgtcgtggaagtaccaaatctcatcgtgcaagaggcggtggaggtgggaaggcgagctaccgtctaacaagaagtagatcgaggtgtattcgtagcggctagccaaggacgtttggtcgtaagttgttttggcgctgtggtacacctggcggtaccacccaccctcgggatggggcgtcaagttgagctgggtgacgtagtcggttttggttggcatcaaaatccctcctttaattggcaggcaatcgttaggctgattgtagcacagactagttgtcttgttccctttcacaccgttatcaaaatcgtaaaacattttctaaactaccgtgaatcgttgggcgaacacccgctagatcggtataatggatttaacaattgcaagtgaaatgggggaagccattatggatcaagtgaagatattaatcgttgatgacgataaagaaattgttcagctattagaaatttacgcccgcaacgaagggtacgaaccagtgacggcttacaatggtaaggacgccatcaccaagctcaacacgatgccagacattagtttggtaatcctggatttgatgatgccggaaatgaacgggatggatgtgattcgccaggtacgcaaggattcctcaattccgatcctggttctgtccgccaagacggccgacatggacaagattcaggggctggtgaccggggccgacgactacgttaccaagcccttcaacccgctggaagtgatggcgcgggtcaagtccttattgcggcgtagcgaaaaccaggtcactaacgacaagcccgacgtcttaaacgtggggccgctggtgattaacaaggattcccacgaggttaagaccttaaagggcgacccgattcagttgaccgcgttggaatttgggatcctctacctcttggctagccaccccaaccgggtctttagcgccgacgacatcttcgaacgggtttggcaacaagaatcggtcgtttccgccaagacggtcatggttcacgtttcccacctgcgtgataagatcgaagccgccacggggggcgaaaaggtgattgaaaccgtgtggggtgtcggatacaaggtcgaaaaccattagtaaagaggagtgctcaccaacctcctcagtctgcgtttgtggtttttaggtgttacacagaaaatatggaaaataaccacaggcctagtgtctaagtatggacaaggaacgatgcgtgccgcatcaacccttgccctagcttagtcatacggcctgtcgaggaggttattttccactctttttaatgggggaaaaggatgttaaagttaaccgggcgggagaagagttccctgttttttgaaggcttactaacgattattttactggggttgatcaatatcgctttgattacgatcattcaaacgatgattcaaagtaaccccggggtccaaagcgggatcttcatcatcaaacagtcgttggtgattgggccctttcacgcccaaatctggtcctaccaacggatcgtgatggccttgttggtgctaattgacattggggttttgtggtggcggctcttgcggcgctaccacctctaccagctggatcacatcattggtgaacttcattacatcgcccagggtcacttggagcaccggattcccttccgtgtcaacggtaaccaacagcacgtgatcacctcggtcaacgccctggttgacacgattacccaggctatgcaagaggaacgggcgtcggaaaagtccaaggacgagttgatcaccaacgtttcccacgacctgcggaccccgctgacctcgatcatcggctacctgggcttgattgaagaccaccagtaccagtccgaagaagacatcgtcaagtactcccacattgcctacgacaaggccaagcagatgaagaacctggtcgaggacctgtttgaatacaccaaggtccaacagcacggcgccccggttaatttgatgaccgtcgacctgggtcagttgctcgagcaagtcggggcctcctttgagctggaagctgataagaaggggatggcgatcaacgtaacttgtgagccaacgcccctatcgatcacggccgaccccgaaaagctgggccgcctcttttctaacctggtcgctaacgccctgaaatacggtcacggcgccagctacatccacctgacggccaagcagctgggcgaaaaggtggtcatcacggtcgccgatgacggggagaagatccccgccgaatcagttaagcacctctttgagcgcttctaccgggtcgagtcgtcgcgtaacaaggccaccgggggaaccgggttgggactggcgatcgttcaatcaatcgtggaactccaccacggctcggtaaccgcccgctccgacgatcaggaaacggcctttgtggtaacgttgccagttaaacaagtacagaaagaagttaggtaatgaataagcaagttaaacgatggttgtaccgcaccggggtcttcttggccagtttaaccatgacggccggcagcctgacggcggttccagcggcggtccacgccgataccacgaccagttcgactagttccagctcatccacgaattcgacgaccgactacacggtcaacgccaaggcggcaatcgccattgacgccacgaccggccaggtcctctacgccaaaaatgccaacaccaagctggcgatcgcttcgatctctaagatcattacggtaggggtgattgaacaagaaatcaaggcgggaaagctatcttggaacaccaaggtcaaggtcactaaagaagaggccaagttatcggaaaataccgagtactccaacatcaccctaacggcgggtaagagttacacggtcaaggagttgaccgaagcggtgatgatcaagtcggccgatgccgccgccattaccctatcgcgggcgaccggcgattccacggcgagcttcgtcaagaagatgcaagccttcgtcaaaaaggccggggtcaccgacgccaagctgtacaaccaagtcgggttgaccaacagccaaatggggagctacggcctcaagggggtcgccaaaaacgccgaaaacgaaatgacggcaaccgacgtggccaagatcgcccagtacttgatcaagaactacccgagcctgttaaacatcaccaagttgacttcgaccacgattgatggcactaccgttaccaccatcaataagatgctagccgggcaaagcgacgccccgacccaggttaagatcgacggcttaaagaccgggacttcggacaaggcgggcgcctgctttgtttccaccgggacctaccaggggcaccggatcatcatcgtggtcctccacgctactggtgggggtgatgaacggttcacccaaaccgccaacctctaccacttaatcgccaacgaatacacggcctacacggttcaaccaagcgtggccgcaacggtaccgaacgggaaggtcaccaccacgaccttgaccactcagggcaagatcaccctctggaagaaggacggcaccctgctgtcgccgagcctagccatcaacagcaaggccgccgacaagaacggtaagctgaccgccccggttaaaaagggccaggtggtcggtgagctgacttacgccggtttgaccggtttggacggcaataagctgaccgtcgacgtggtaccaaccaccaacgttgacaaggccaacgtcttcgtgcgcatgggccgctgggtaaagagccatatctaaagaaaagaagtgcgaaccaaccatttgccctagcttagccatacggctcgtcgaggaggttagtcgcacttccgataacgtgctcctaaccacgagcctagtggctaagtacgggtaaagaacggtgctggcgcaccaaccatttgccctagcttagccatacggctcgtcaaggaggttagtcgcacttccaatatttcccgggaaattaccaccgaagaaaagagatggctgctcacgtccggttagatatggtaaactattctttagccgggtcaaaaacccgtccgaaagaaagcgaaatagacaactcattatttgtggaggaattgctttggcaaaagcacatcaaatcaacccggaacgcgcccgctggttggaggtcctgggggtttccatgcccctttgtctgtcctacctgccgatcgggattgcgtgtgggatccttttgaacgctgcggggatgaacttcgtcttaaccttcttggtttcgatcatggtcttctccgggggggcccagtttaccctggcgtccctgttggtcagtgatgcgccgatcacctcgatttttatgaccctcttcttcttggaactgcgttacgccctcttggggtcgagcctttctcgctacatgcgcagcgaaagccagaagttggtcctgattttttcggcctcaatgaacgacgaaaactacgccatcaactacctgaagtttgtgaccgacaaggactggtcggccaaagacgccctcttagttgagtactactccctggcttcttgggccaccgggaacctgctcgggggtctgatcgggtccgccgtgcaaattgacttagtgatcgtggacttcgccttgacggccctctttatctacatgatcgtgatgcaagtgcgccagcgcctgacccttttcatcgggatcctgtccgccggtctgtcaatctacttcttgaccctggttaagtcgaccttggggattatcttggccaccgttttggcttcctttgtcggctttatcattgaaaaccgggtgcgccattactccaaggatccggatcacacctggattttgggtaagctgtttaggccgtccgcaacccataacacggtggaagaccgccagcacatcaaaaaacaagaagaggcgaaggccaaggttaccaagaccgacgcccagctagatttaaaaggatgatggtgaataatgatgggatggatgaattcaattaacctggcggaagcacagtcgttgattccgagccaccacaacctaacttaccacctgatcgtgatcgtgatttcggcgatcgccgcctttgtgccgcggtacttcccgatgcggttcttcaccaaccgtaagattccggagtggtttaacgaatggatgaagtacgtgccgatcagcctcttcaccgccctggtcatcaaggggatcttcatcacctcggattacagcttggtgcaagaccacgttaagttgctgggcaacctagccatttacggccacgccagtcaaatcgtggcggccattctcgtggcgatcaccgcctacttcacccgctcgatggcggcctccgttctggtcggcctggtgggtgtctgggcgctgggcctgtttttataaaagaacgaaatcaaaataagggactgagagaagctcttttctctcggtcccttttcttgtggttaatgttattacagcacccgcgggcaatttctttggccgaccgctccaacggtcaagtcgttgatcgcttgtccaagtcggtgctagcggacgtcttgtggcgcttcaggcatttcttttagggggctttattgatgaccactgcttacttaattcacggcacctcaacgcgcgatgacgactggtttccctggctagaggaggccctggccccggccgttaaactcgagcggctttggcttcccgacccgtttgcgccgacgcaggcggcctgggacagcgccctggaggatcaaatcaaaccagcagacggactgaccctagtggcccacagtctcgggtgcgtaacggcgctgcgctatttagcccgccacccggaaatcaagggggccaacctggtcttggtgggcgccttcgttgacccgctgccgacttacccgagcctcgatgcttacatggccggcgaactggatttaaaggccttgcaaccgcaacttcaccgggcaacagtgattgtggctaaggatgactacgtggccccctaccagctgggggtagcggtagccaaggggctaggcgctaagttgatcgtccaagaccgcggcggccacttcttaaccagcgacggttacgaacaattcccgttagttttaaaagaagtgggacgggtgatgggctaggggacaggacaaatctgcaaatttgcgcaaatctagtggctagatagttggtccgcgcttctgttttgcacaaatctaaatatttgtcctgtgtaaaaaaggaaagtgtgacccaacctgtcaagtagaccgttggactaagctagacccgtggttaggagcgcattatctgtgtaataatcaaaaaaagaccgagagaaatttttctcccggtgaagtgaacccccgagattgttgtccaatctcgggggttcacttcacggtcgcacttcttttatataatcatgtaatcccgtgtcatcggcaagttcttacccgacgcccccttggtaatcaggtattggatgacgtcgatgttgccggactcaaaggacgccgcgcaggcctgcaggtaaagttcccacatccgcacgaagcgttcgcccatcatttcggtgaccttagcggtttgggcctggaagttttggtcccaaagttccagggtccgttggtagtggcggcgtagcatttccacgtcgtcgatttgcaagccggcgtcttcgatgtggccgatgatttcggtcaagcccggaatgtagccacccgggaagatgtatttgttgacccaggcgttaaaggcgcccccttgttggcgggtaatcccgtggatcagggcgaccccgtcgtcaaccaggtagttggccacgtccttgaagtagagaccgaggttttcggcaccgacgtgttcaaacatccccaccgaggtgatgtaatcccactggcgatcgcctaattcacggtagtcggtcaagtggacttccgccacgtcgcttaagccctcgtcatcgatcttcttttgcaccagcttaaattgctcttcggacagggtgaccccggtgaccttgagaccgtactcgcgggccgccgtcagcatcaaggtcccccagccacagccaatgtccaagagggtcttgcccggttgcgggtgcagtttttgcaaaatgtggtgaaccttggcgatttgagcttgttccaagtcgtcttggttgccctcttcaaagtaggcacaggagtaagtcatcgtcttgtctagccacagggcgtagaagtcgttgccgacgtcgtagtggctttgcacgtcggacatggaactcttcttgctgtggttttgcttaggcatgaagcggcgcagcttggagtcgcgcatgaagctttcggcgctttggtaggccgcgttgatcaggatctcgatcacgttggccggacccgagagctcgatctttttatccataaaggcttcccccagggctagtgaggcgttgcgcgttacgtcagcgaccgggatcttctcgttaaaggtaattgtaatttccggatccccatccccgtaggttgccgtggagtgatcccaaaaaaccactttcaccgggacgttcttaaaagagcggctcagtaacgttttatagaacgtcttttctaacatctgtccatcatccttctttcacaattatatttgttaattatacaccccgggtgtcaaggttttattaaaagtgctcacccttgcatgaatcgtttcagtcggggtgcataccgtcaatcaaacggaggtcgacaatgaactcaaacggaaccgaggacctgcgggtccaaaaaacgatcaccgcgatttaccaggcctttgaggagctgattttgaccaccgattacgaaaagatcacggtggccgaactggcccgccgcgcccgaatcaataaaaagacctttcacgttatggcgggttctttgctaagatagggttatcaactgggaagggatctttgccatgacagactttttgaacaaatttactaaaaaacaggagctccgccgcttggtggtcctcttggtgatcgtgttggtcttatacgaggctcgctcgctgatgaacacgatcttgttgacctttattttcacctacttaatcgtccactgggtccgcttggtccaacgttggatcccccgggtgccagtcaccctggtggtcttgttgagctacttgcttttgatcctaggcctcttttacgtggtcaccgattacgtgccgatgttggtcaaccagctggttaagatgaccaattcgctgattaccttctaccaaagtgccgacatgcactggctgatgaagtacctcaaccagtttgtgtcgagctcgacgttggccacccaagcccgccacggggttaccctagccgtgaccaccttgaccaactttgggaccttactggtagcggtggcgatgtcggtaattttgagcttcttttacacgattgagcttcgccagatgaacgagttttctaagaccttcttgtccagccaacacctgagctggtttttcaaggacctcgatttcttcggtaagaagttcgtcaacacctttggggtcgttttagaggcccagttctttatcgccttaaccaacaccgctttgaccatgatcgccctgttcttcatgaagatgccccagatctttgccctcggcctcatggtcttcatcatgtccctggtgccggtggccggggtcatcatttccttggtgccgctctcgatggtcgggtattcggtcggcgggatccgttacatcgtttacttaatcatcgtaatcttggtcatccacatgattgaatcctacgttttaaaccccaagttcatgtccagccggaccgagctgccgatcttttacaccttcgtggtcctcttggtgtccgaacacctctttggcgtctgggggttgattgtcggggtgccgatcttcaccttccttttggacatcgtgggggttaagcagattcgggcccataagttaccgacgacccgggacaaataagacttgcaaccgggagttagttcgattattgttaatcttgtaaattagattgttatataatgttcggatttaacgggaggatccaccgtgttaactgatattgaaattgctgatcaagcccaactcaccccgattaacgaaattgccgcccagctggggctcgatgaagatgccatcgagcaatacggcaagtacaaggccaagattaacttaccagtacaagcgacgccggaaaagaagcacaagctggtcttggtgacgtcaattaacccgaccccggctggggaagggaagtcgaccgtcctggtgggcttgggggacgccctgtccttattgcaccatcaaaccgtcatcgccatgcgcgaaccttcgatggggccagtctttggcatgaaggggggcgccaccgggggcggttactcccaagtcgtgccgatggaagacattaacctccacttcaccggggacttccacgccctaaccagcgccaacaacaccctggccgctttgatcgacaactacctgatgcggggcaacgaactcggcttggacccgcggcgggtgatctggaagcgggtcgaagacgttaacgaccgcgccctgcgtgacgtggtgaccggcctgggcgggattatgcagggggtgccgcgccaaaccggctttgacatcaccccggcctccgaattgatggcgattttgtgcctggccaccgacctgagcgacttaaaggcccgggttagccggatcgtggtcggctacacctacgataaggaaccggtcacggtgggccaactcggctttgaagaggcggtgacgatcctcttaaaggacgccatcaagcccaacctggtccaaaccctgggccacaccccggcgatcgttcacggggggccgtttgctaacattgcccacggttgtaactcggtcttggccaccaaaacggcgctacaattagccgactacacggtcaccgaagccggcttcggtgccgacctgggggccgaaaagtttttggacatcaagcggccggtcctgggcaagaccccggacgccgtggtcatcgtagcgaccgtccgcgccctcgaatacaatgggggcgccagccttcaagcattaaaggacgagaacctgaccgaattagaaaacggcctgcaaaacctcaaccgccacatcgccaacatgcaacgctacggcctgccgttggtcgtggccatcaaccactttgccaccgatacgccggccgagatcaaactgatcgaagacaactgcaaggcccgcggggtcaacgtggtggtcgccgacgcctgggccaagggtggcgcggggacgctcgacttagccaaggaagtggtggccctggccgagcaagaagccagcttcaccccgctgtacgactaccaagccacgccaaaggaaaaggttgaaacgatcgccaccaaggtctacggcgccggacgggttgccttttccaagaaggccttaaaccagctcaagcagtttgaaaagctgggctggaacgacctaccgatttgcatcgccaagacccagtactcctttaccgacgaccaaacccaactgggggcaccggagggctttaccttccacatccgcgagttcgtaccgaagttgggggccggctttatcgtcgctttagctggtaacatgctgacgatgccggggctgccaaaggtgccggccgccgttaagatgacgattgatgccgaggggaagataacggggttattttagtaaacaatggggttgggggaatggttcccccagccttttttggtttccggttacacagataacgtgctccccaaccacaggcctagtggctaagtacgggcgaagaacgatgcgtgccgcatcaaccttccccctagcttagcccacggcctgtcgaggaggttggtccgcgcttctctaaaatccgaacaattataaaaagttaatctaatctggttcgtgaatttgcttgttttcgcccgggcggtttggtattctaaagacagtttgagaagggggaacaagcatgagtaagatttccgttgtaatggggagcacctccgattggccaaccgtcaaggaagggtgcgccatcctcgatcagttcggggtggcctacgacaagcaggtcatttccgcccaccggatgccccaagaaatgttcgactttgccaagcaagccgccggcaaggggaccaaggtaatcatcgcctgcgccgggggggccgcccacctgccggggatggtggccgccaacaccccgctacccgtgattggggtgccggggcagaccaaggccctgggcgggatggactccctgctttcgatcgtgcagatgccggccggaattccggtggccacgacggcgatcggggtggccggggctaagaacgccgccctgctcgcccttgagatcctggggacgaccgacccggcgatccaagcacagatcgtcgcttaccgtcagcaaatgcacgaccagtccgtggaaagcagtgccgaccttgactagggcgggctacattccccagggggggacgatcggcatcatcggcgggggccaactgggccagatgatggcattggacgctaagtacgccggcatgaaggtgattatcctggacccgacgcccaactgcccggccggccagtgcgccgacgaccagattgtggcgccctacgaggacaaacaagcgattgaagagctggctaagcgcgccgacgtgttgacttacgagtttgaaaacgttgacttggtggccctagaagcggtcgccgaccaagtcgccatcccgcaggggaccgaactcttgcggatcaccaaggaccggatccgggaaaagaccttcttacaagaagcgggcctctcaacggcgccctttgcggcggtcactaaccaggccgaattagaggcggccgtcaccaagattggctacccgagcgtcttgaagacctgcgaagggggctacgatggccacggtcaagtcatcctgaaaagcgccgcggacctggcgaagtgcacggatgtcttggcgactggtaactgcatcttagagggctgggttaaatttgacctcgagtgttcggtgatggtggccagaaacgccaaccaagagatcgttaccttcccggtcagcgaaaacatccaccaaaacgagatcctgcacctgtcgatcgtgccggcccggatcagcaccgccctgcaggaacgggcccgggagatggctaagcaaatcgccgagcaactggacctcagggggatcctaggggtggagatgtttgtcgcccacaacggccacatttacattaacgaactagccccgcgcccgcacaattcgggtcacttttcgcttgaggcctgcgacttctcccagttcgccatccacaaccgggcgatctgcaactggccgctaccacagccaacgttattaaagcccgccgtcatggtgaacgtcttgggccaacaccagaagggcgttgccgctttaatcagccacaagcccacctggcacttccacgattacggcaaggccgacagccgagttaaccgtaagatgggccacgtgaccatcctgaccgacgacttagacgccaccctagaagaaattgctgccacccacgtttgggacgcttaaaaagagaggaactaactgatgattgatcgttacacccgcccggaaatgaaggaaatctggagcgacaaggctcgctaccaatgctggttagacgttgaaattgccgccgacgaagcctggagcaagctgggctacattccggccgaagacgtcgaaaagattcgccaaaacgccaccttcaccgttgaagggatcaacgaaattgaagccgtcacccaccacgatgtgattgcctttacccgcgatgtttccaagtccttggggccggaacgcaagtgggtccactacgggctgacctccacggacgtcgtcgacaccgcccagggcctgcagttaaagaaggttaacgacatcctgcgccaagacatccaggacttcatggacatcctggccgaccgggcccgcgaatttaagtacaccgtctgcatgggccgcacccacgggatccacgccgaaccaactacctttggtttgaagctggcccgctggtactcggaaatgaaacggaaccaggaacgcttcgagcacgccgctaagggtgtcgaagccggtaagatctccggggcggttgggacctttgccgaagtcgacccgcaagtggaagcctacgtttgccaaaagctcggcctgcgtccccaagaaatctccacccaggtcctgccccgcgacctgcacgccgaatacgtagcggcgatcgccttagtcggtacggccctggaaaacatggccaccgaagttcgttccctgcaacggaccgaaatccatgaagtcgaagaacactttgctaagggccaaaagggctcgtcagccatgccgcacaagcggaacccaattggctccgaaaacatctgcggctgtgcccgggtcctgcggggcaacgtagtgaccgcctacgaagacgtgaccctctggcacgaacgcgacatctcccactccagtgccgaacggatgattctgccggactccacggcgctgttggactacatgctccaccgcttcggtaagatcatcaagaacctggacgtcttcccggaccggatgaagcataacatggacgaaaccctgggcctgatttactccggacgggtactgctcaagctggttaactccgggatgacccgtgaggacgcctacgacctgatccaaaagtacaccgccaagtgctgggccgaccacgttccgtaccgcccgctcttggaagccgacccaatcgtggctaagcaactgaccaaagaagacctcgatgacgccttcgactaccattggcacctgcgccacgtcgatgacatcttccaccgggtagggttggactaattagtgagtgcgaccaacccattgagcccccgttgcctacgttaggcggcgggggctttttatcttaagttaaatgattgttccaccccgcggctgattgtataataaatgtaacgtttaaagttacattgaatgattaatcaaggggtagagatcatgcaaacatgtccaaactgcggggcccaaatgcctgccgacactaagttctgtaccaactgcggcgctcagctagcggtggccgaagccaaaccggcagcggcgccgcaatcaaccgccccaacgacgaaagaagaggcgccacaagcgacgccgaacgtctgcccaatctgtggcgagccctacgaggaggggaccaagttctgtactaactacggtcaaccgctgaccgcggagaaaaaggaaccgggggtggcggcgagcgcgatgaacgccgctagtaccgccgttaaaaatgtcgataccgaccggctcaaggccggggcggtgggctactggagctggctgtgggggtcggtgaaggcgccaaccaaggtggtgcaaccgaagtttaagtacaccggggtcttaacgattgtcggcgaaacgttgttggcaatgttagcgatcttcgccgttctaacgcgggcgcttcacgcggccacctcggcgtttgggggttcctggtttgacacccttgccataatcaacgggcacacgggcactggagcagcctcgaccacgccgtccgcaactggccttttgttccggggctggctgtttgcgatcgtcgccgcactgttgatgatcgcctgcgcctacctcttgcaacgggtcagccaacgggagccggaaaacgatttttgggtctttaccaaccaggtggtgcacgaaaccaacctgatcgccttctttaacctggccctgttagtgatcgcgctcctgtttacctacaccacggtggttatcttcatggtgatcttgttcagcttggacctgagtttgttgacggtctcgctgtaccgggcggtcttgcgtagcgatcacggggccggcagcctcgatccggtgtacgccggtctaattttagcggtggcaattggcctgatttacatgctgttctccttcttggtggggcaagaactggtggcctccgctttgaaatcgttcggcgactttatggatagtctattttaggaggctggatcatggcatcaaagttttgccccaattgtgggcacgaattaaagcccggcgcccgtttttgtccgaactgtggctaccagctgcggacggccacggaaccggcaccgggctcggctagtcaagcaccggagtctaaggtccctgagcagcgcccaactgaagttgcttcggccaaccccgtagcttccacgcggtccagccaaccaagtgcggcgccgcaatcaaccgccccggcggctaagcaagcagcggatgaggcaccaacgccagcccgggctcagcgccggcagcgcccccagggtaagtcccgcaagccgctgtggatcggcgttggggtggcggtggtcgtcttgatcgggggttacgccgtcgggagtagctactactcccggcaaaaccagctcaaccgggcgatcagcgccctttcgtcaaccaaagaggacgcctcaccctacctggtcagcgccaacaccagcctgaaggtcaccaaggacaacgcaaagccgttgcaacgctactttaccggtcacgccagcgaactcagctccctgaagcaaaccttcttgactagcgacacctacggcaattaccgctacgtgcgttcgggcagtcactggctgatcttcccgcgctaccaaatttcctttgaaccggcctacgccgagttaatgactaaccacgagggagtcacggtgaagatgggtggtaagcaggttgccacgcttagcgccaacgatcagtccagccgttcttattactccagcttcagcaacgacgcccagaccgcctacacccacaaggttgggccatacgtgccgggggactactcctttacggccagcgggacggtgaacggtcgcaagatcacagctaaggccaacaccaccctgacgccggggagcacgaccaccgtcgacgtcgggctgtcgactttgaccttcaccgtggtcggaccgagcggggcgacggtttacgttggcggcgataaggccggcacgattggcgacagtggtagcctggaactcaaagactacccagtgagcggcaacaccagcgtttacttgaccgtcaacgccagtggtaagacctacgaatccaagcacgccacgattggcaaggacctcgattacgacaaccagatcgccccgaccttcaccgggatgatttctaaggatgacgccgacaccctgatgaaggacgtctactcagaggccctgaccgtccgtgacagcaccgatgatagtaccctggccgattacttcaaggatggtgccagcaacgagtactaccagcagttaatcaagatggccaatggtcacagcggcaacgattcgattgatagctacgattacgaggcccgggttaactcggtcgccccggccggcgataaccaaaccaccgttaactacgacgtcacttacaccttcgactttgaagacggcagcaccaagacccaggtcttccgctacaacgggaccatcgtcaaagacggcagcgactacaaggtcgtttcactgggggacgccaagaaggtgagtgagaagacggaataaggaagtgcggaccaaccataaagcaggccgtggggtaaggatagggtacaggttagcgcgtcagcggtgttctgtggccagacttagccactaggcctgcggttgggagcacgttatatttggaagtgcgacccaacctcctcgacggggcgtatggataagctgggacgaacggttgatgcggtacgcatcgttcttcgtcctgcttagacactagccccgtggttggggagcacgttatctgtctaacattcgtgaatacaacaagaggctgggagaaaatcgtgttttctcccagcctcttttttaaaaaccgttaaatagatgattaacgaactagaaaccgttatcttaaaccgttttaccccatccttgcgattaaacacgaacattaaagtgataattccattaaaatggcgtcgatttgttgacgagtgatgataaaacttgttattctatggtcacaatttagcgaatttatcgccgaaaataataattattgttcgtgttttactgaaagggagtcaccgcgaaaatggaagagaagctgttgtacgccgggaaggcaaaggaaatgtggaccaccgaagatgaggaccaactgcgggtggtgtacttagatcaagccacccagttgaacgggaaacaaaaggaacactttgctggcaagggggccgcggcccacgccatttccgacctggtcttccactacttgattgaccacggaattgaaacccacttcatcaagaagctgtcggcaaccgaggacctagttgaaaagtgcgccatggtaccgctggagtttgtgacccgtaacaccgtcgccggccacttcgcttcccgctttggcctggaggaaggaacggccctgccgcaaccggtcgaagaaaacttctacaaggacgacgaattagacgaccccttcattaacgaatcggccgccgtcgccttaaagatggtgaccccggcagaatttgaccggtgctgggcgatttgccgccaggttgaccaactgctaacgccgctctttgaaaaggccggcatgcaactggtggacttcaagctcgaatttggccgccggagccgggataaccagattatcttggccgacgaattctccccggataactgccgcctgtgggacacgactactcaccaccacctggataaagacgtcttccggcgcaacctcgccgacctgacgaccacctaccaagaagtgtacgcccgtttacaagtagccctaaaggaggactaattatgaccaccgttcggatttacgtgacctacaagccatccgtttttgacccccagggggaaacgatcaccaactcgatccacgccctcggccaccaagacgtgaagagcgtcaccgtcggcaagttctttgacgtaacggttgatggcgaccaagttgaagcgacggttaagcaaattgccgaggaactcttggttaacttcaacatggaaacctacacctaccaagtactggaggagaagtaaatgaagattgcggtgattgtctttccggggtcgaactgtgacatcgacctttatgaagcgttgaagatggtttgcggcgccgacgtggactacgtcgaccaccagcaaaccagcctggccggctacgacgccgtgatgctgccggggggcttttcgtacggtgactacctgcgggccggggcgattgcccgcttcgctaagatcatgccggaagttaagcgcctggccgacgaaggcaagccggtctttgggacttgcaacggttttcagattttaaccgaggccggcctgttaccgggggcgctaaagaaaaacgacagccaaaacttcgtctgcaagacgacgccactagaagtcgtcaataaccaaacgatcttcaccagccagtaccaagaacacgaacggattaacctgccgatcgcccacgccgatggttcctactttgccgaccaagccaccttggacgagctggaagctaaccaccaggtggtctttcgttacgccgaggaaaaccccaacggatccttaaacaacatcgccgggatctgcaaccgggccggcaacgtcttggggatgatgccgcacccggaacgggcggtcgaagcaatcttgggcaacaccgatggcctgcgggtctttaagtcactgttggaaaacggcacggtcattgcggagggataggaaatgaagcaagcattaacgccagaacaaattaaggaacaaaagccttacttggactggagcctaagcgagcgcgaatacgactacatttcagaaaaactcctgggccggttgcctaacttcaccgaaaccgggctcttctccgccatgtggagtgaacactgttcctacaagaagtccaagccggtcttgcgcttgttccccaaccaaaacgaccgggtcctccaggggcctggtgaaggggccggggtcgttgacatcgatgacggccaagcggtggtcttcaaggccgaaagccacaaccacccgtcgacggtcgaaccttaccagggggccgcaaccggggtcggggggatcttgcgtgatatcttctcgatgggggcacggccaatcgccagcctcgattccctgcacttcggcgaactcgacgacccgaagatgcaaatgaaggtcgccggtaccgttaaggggattggggattacggtaactgcatggggatcccaaccgtggccggggaaacgacctttgacccgtgctactcgggcaacctcttagtcaacgccatgagcgtcggcttgatggaccaaaaggacatccaaaaggggaaggccgccgggatcggcaacgccgtgatgtacgtcggggccaagactggtcgtgacgggatccacggggcaacctttgcctcggccgacttctccgacgaaaacgccacccagcggtccgccgtgcaagtcggggaccccttcatggaaaagctgctcttggaagcctgcttggaattgattcaaaaccaccccgactggttagtggggatccaggacatgggggcggccgggatcgtgtcctcgtccgccgaaatggcgagcgaaggggatgcggggatggacctcgacctcgacctcgttccgcaacgcgaaccgaacatgtcggcctacgaaatcatgctgtccgagtcccaagaacggatgctgctgtgcgtcaacaagggccacgaagacgacgtcaaaaagatctttgacttctacggcctggaagccgtcacgatcggccggatcacggaggggcgccagtacgtcttgcaccacgacgggcaagtcgtttgtgacatcccggtttccagcttaaccgacgacgtcttagaagaaacctccgaagaacaaaagccggcccggattttacaggccgaacaagagactaactggcaaccggaagtaacagacgccggggcgaccctggaacaactgctccaacagtcgacgatcgccgacaagtcaatcttctttgaacaatacgactcgatggttcggacctcgacggtggtcggccccgggtctgacgccggggtcttgcgggtccgcggcaccaagaagggcctggcgatgacgaccgacggcaacggccgcttcgtgtacctcaacccggaagttgggggcaagatggccctggccgaagcggcggctaacattgtcgccactggggccctgccactggcgatcaccgactgcttgaactacggggaccccaacgacccagaaatcttctgggagctccaccaatcagtgtccgggatggccgaagcctgccgggtctttgacaccccggtcatttccgggaacgtttccttgtacaacgaaaataacggccaggccattcaccccaccccaatggtcgggatggtcggcctgatcaaggacttaaagaacctggttaagatggcggcccaagcagccggcgaccaagtctacctgctgggccaaaccggtgacgactacgccggtagcgaactgcaaaagatgctgaccggcgacatcgccgggacggtggccgacttcgacttaaaccacgtccacgccatgatgaaaaccctgctgtccctaatggaagatggcaaggtagcgtccgcgcacgacctggccgaagggggcctgggggtcgccctagccgaaacgctcttcaagaccgacctggggatgaacctcaagctcgacttaaccaagaaccaactctttagtgaaaccgccggacgctttgtggtgaccgtcaaaaaagaagacgctgcggcctttgaggcggccctgggcgacgacgccacgctgattggggaagttaccaacagccactggctccaggtacgcctggcggacggcaacctgaacaaaaacgttgccgacttagaacaattgtggaaggaggccattccgtgccagctgaaatcaagggattaaatgaagagtgtggggtctttggggtctttggcgccgaacacgccgccagcctgacctacatgggcctgcacaccttacaacaccggggccaagagggggccggaatcgtctccaccgactaccaaaccctttaccaacaccgggatcgtggccttttatcagaggtctttgccgacccggccgaactggaacgcctagtcggtgacggggcgattggccacgtccgttacgggacttcggggcacaactcgattcaaaacgtgcaaccgttcctctaccgcttccacgatggcgacatcgccctggcccacaacgggaacctgaccaacgccgtcaccctccggcgccaattagaggatgaaggggcggtctttcaatccgattccgataccgaaatcctgatccacctgattcgcaagcacatccagtccggcttcattaacgccctcaagcagagcttaaacgaagtcaaggggggctttgcctacctgcttttgcaaaaggaccgcttgatcgccgctttggacccgaacggtttccggccgctgtgcatcggccaactggagaacggcgcctacgtcgtcaccagtgaaacctgcgccttagacatcgtcggggccaagttcgtccgcgacgtcgaacccggcgagttgatcatcattgaccgagacgggctccacgtcgatcactacaccaccaacacccagctggcaatttgctcgatggaattcatctactttgcccggccggactcgatcatccacggggtaacggtccacaacgcccgtaagcaaatgggccgcctgctcgcccgcgaacacccggttgacgccgacatggtaattggggtgccgaactcctcgctgtcggcggcctcgggttacgccgaagaggcggggctcccgtacgaaatggggctgatcaagagccaatacgttgcccggaccttcatccaaccgacccaggaactgcgtgaacgggcggtgcaaatgaagttgtcggccgtccgcggggtcgtggaaggcaagcgggtgatcgtggtcgacgactcgatcgtgcgggggacgacttccaagcagatcgtccaaatgttacggcgggccggggccaaggaggtccacctgctgatcgcctccccgccgtttcggttcccgtgcttttacggtatcgacgtgtcgacgcgggccgaactaatggccgcccaccacacggtcgaagagatgcgggatttgattggcgtcgacagcctcggcttcttgtcggttggcagcctgatcgaagccatcaacctggccaacgtcaacggggcgcccaatggtggcctgacggtcgcctactttaccggtaattacccaacgccgctctacgattacgaggagggctaccgcaagtcactgagcgaacaagagaaactggccagaaaggaagtcacggtctaatgaatcgataccaagaagccggcgtcgacgttaacgcgggttacgaactggtcaaacggatcaaggaaaacgtcaaatcgactaaccggccgggggcgctcggcggcatcggggcctttggcggactctttgacttgggcgaactgaaggttaagcacccggtgctggtgtctggcaccgacggggtcggcacgaagcttttgatcgccaaggccatggatcaacacgacacgatcgggatcgacgtggtggcaatgtgcgttaacgacgtcttagcccagggcgccgaaccgctctacttcctcgattacatcgctaccggccacaacgacccagccaagatggccgatatcgtggcgggggtggcggaagggtgccgccaggccggcgccgctttgattgggggcgaaaccgccgagatgccggacatgtacgaccaggatgaatacgacctggccggcacggtcaccggggtggtcgaaaaagacgacctcttgactagcgaccaaccacaggcgggcgccattttgttggggttgtcttccagcgggattcactccaacggtttttcgctggttcgccaaatcctctttaaggaccaccaggttgacctagccgcaacgccggccaaattgggcgggcaaacggtcggccaagccgtcttggcgccgactaagatctacgtcaaactggtcttgccgctgttaaaggaccacctggtcgaaggggtcgcccacatcaccgggggcgggttgatcgaaaacctaccgcggatgtttggcgacgacctccaggcccaagttgacagcagcgcctggccaagcctacccgtttttgactacctcaaggaactgggtgggttgagtgatgacgattgctggcaaacctttaacatggggttagggatgatcctagcggtgcaaccggacctagtggaccaagttaagagtcggctgaaccaagcgggcgaggcgtgctaccaagtggggcaactggtcaaccggccgaccggcgaagagaagattgtgattaagtgaggaagagcatgagagtagcgatttttgcgtcaggaaacgggaccaactttgaaatcttggcccagcaatttcaaaaccacgacttaccgggcgacttagtgctgttattttgcgaccaccccacggcccacgtaattgaccgggccaagcgcctgaaggtcccttatgaaaccttcaccgttaaggaatgcggtggcaagcctgcgtatgagaagagaattttgaaggtcttacaagactaccaaatcgactttgtcgccctggccggctacatgcgggtggtcggcccgacgattttggatcactttgggggttcgatcgtcaacctccacccggcctacttgccggcctacccggggttgcattcaatcgaacgggcctttgccgatcaccaaacacaaaccggggtcaccatccactacatcgactccgggctggactcgggcccaatcatcgcccaagagcacgtggtaatcaagcccgatgatacgatcgagagcttagaagaacgggttcacgaaacggaacaccgcctctacccagcggtcctaaaagaagtcttaaccaagcgaattgaaaaaggagaatagcatgaagcgcgcattagtttctgtatcggacaaaaccaacttggtgccctttgtaaaggggctggaagagcacggctacgaaatcgtctccaccggggggactaagaaggccctggatgaggccggcattaagacgatctcgattgaagacgtcacccacttcccggaaatcttggacgggcgggtgaaaaccctcaacccttacgttcacgggggcctgttagcccggcgcgacttgccggagcacatgaagaccttagaagacctgtcgatcaccccgattgacctggtgtgcgtcaacctctaccccttcaaggaaacgatcttaaagtcgggcgttgaactggccgatgcgatcgaaaacattgatattggtggcccgtcgatggtccgttcggccgctaagaactaccaaagcgtcacgatcgttaccgacatcaacgattatgaccaggtcctgaccgaaatcgaagaaaacggcgatacgaccgccgaaaccaaggccaagttaggggccaaggccttccggaccaccgccgcttatgatgctttgatctcccagtacctgaccgctcaagtgggcctggaagacccggaaaagctgactctgacttacgacctaaaggaaacgatgcgctacggggaaaactcccaccaacgcgcttggctctacgaagacgccctgccgaagagcttctcgattttggaggccgaacaactccacggcaagaagctgtcctacaacaacatcaaggacgccgacgaagccctgcggtgcgtgcgtgaattcgacgaaccaaccgtggtggccatgaagcacatgaacccgtgtgggattggccgcggcgacagcctggaaatcgcttgggaccgggcctacgaggctgattccgtttcgatcttcggtggcgtgatcgccctgaaccgcaaggtcgacctggcgaccgctgaaaagatgcggaagatcttcttggaaatcatcgtggcgccgggctttgatgacgatgcctttgcggtcttggccaagaagaagaacatccgcctcttgcaagtcgactttgaccaaaaggacgaaccaaccaaggacgaagtggtttccgtgatggggggactcttgatgcaagaccaagacacgcttaaagaggactgccacgactgggaagtggtgaccgacgttaagccaaccgaagaccaattgaaggcaatgatgtttgcttggaaggccgttaagcacgctaagtccaacgcaatcgtggtggccaacaacgaacggacgctaggcgtgggggaaggtcaaccaaaccggattgactccctgaagatcgccgtcaagcacgccggcgacttggtcgaaggcagcgtcttggcctccgatgccttcttcccgtttgacgactgcgttaagtacgccggcgaacacggcgtcaaggcgatcgttcaaccagggggctcggtacgcgaccaagactcgattgacatggccaacaagctcgggatcgccatggtgacgaccggggtgcgccactttaggcactaaaaagaagtgcgatccagcctttggcaggccgtgggctaagctagggagggggttagtgcggtacgcactgttctccgtccgtacttagccactaggtctgcggttggggagcacgttaaaaagaagtgcgatccagcctttggcaggccgtgggctaaggtctggcatcctttggtcgggcgtacatggtcaatttaaaattaaacaggggttgggagaagggaagctttttccaacccctgtgcctgttcatggaaaatcaggaggaaaatcatgacattacaaaacgtgttggtgatcggtaacgggggccgcgagtttgcgatcgctaagaaactaaagcaaagccccaaggtcgaccacgtctactgcgcaccgggcaacgttgggatgccaacggttggggttgaaccggtggcgatcgaagaactggactttgctgggttgattaagtttgcccagaagcaccaggtagcctggaccttcgttggcccggaagacgccctggtggctgggatcgtcgacgaatttcaaatggcggggctaaagatctttggccctaacgcccgggcggcccagctggaaggttctaaggaatacgccctctcctttatgaacaagtacggggttccaaccgccaagcacctggcctttgaaaacgaggccgaagccctgacgcacgtggccgacttcggcttcccggtcgtcttgaagttagacggcctcgccggcgggaagggggtcgtgattgcgagcgaccaggctgatgccgaagcgacgattaaggaaatgtttgcggaccacaccggccggctggtgattgaagagtgtttggtgggaccggaatattcgatgtttgtcctgatcgaaaacggcgactaccaaatcttaccgatggcccaggaccacaagcgggcctacgatggcgataagggtcccaacacaggcgggatgggcgcctacagcccgctgccccagttgagtgaattcgaccgccaacggatggtcgaagaagtggtggaaccaagcgtcaagggactcgtggacggggagtacgactaccacgggatcctctacatcggcttgatgctgactgaagatggacccaaggtgattgaatataacgttcgcctgggtgacccggagacccaagtgatcttgccgcggctggcaaccgatttatttgacctggttgacgcttgtgtcaacgaccagcccctgccggaagtggttgaaaaagaggacgccgttttaggggtggtggtggcctcaaagggttacccgcaaaagccggtcaaaaaccaagcgttgggcaagttcccggtggccggcaacatcacggtcgattacgctaacgtggccggtagtttagccgacttacacggggcggggggccggctgttgatggtgattgccatggctagtgatttaaagcaggctcaacaagacgtctacgcttacctcgaccaactggaggaaccggagtgcttctggcgccaagacattggggaaaaggcgtttaagtaaggaagtgcggaccaacctcctcgacaggccgttgggctaagctagggcgggggttagtgcggcacgcactgttctcagccctccaattctgttacggcatttctagcaaggattagtgacagtgtagtgaactactcggccataaatgaccgagcttctgggaacacgaagtagtatttaggatgttgcttctgtattcagaatacctaacttacagaactccgttcttttaccacggctagtccctagccaacggcttttaatcctctatggagtatattaactgccgcattaatatctcgatcgtgatgagtaccacatttaggacaagtccattctctaatttcaagtggtttcttcccactatggtaaccacacgtgctacagatctgactggtgtaattaggattaacagtaattaactgtttaccgtaccaatcacacttgtattccagcatggttctaaattggtaccaactggcattcgcaatagctttagctaaatggtgattcttttgtagattcttggctttcaaatcttcaatgacaatcacatcgtattttttaactaaggctgttgttagtttgtgtaagtaatcttgacgttggttcgctatccgttgttggtagcgagccttttgtttttgagcccgttgccaattctgataatcattgagatccatttttacgtctttatgattatggttccattggcaaacagctacggttgcttgatattttcggcgactatacttgctttgccactttgtggcttgattttccaaccacttagcattgaaagtaccaaacttttcaccgtcagaactaatcgctaagtcagcgatcccaacatccaggccaacggtcttgcctgtttttggcaatgcttctggagcaacagtctcgacctgcaaagataagtagtagcgaccagttggaccatagctgacggtataacgcttaattttgccatttacagcttgagaggtcttactagttcgaatgcttcctaacttaggtagcttcattcttctcttggcaatcactgtgcagaccgaccgaccagtatatgactgtttggcggcgtgcctgcttttaaagcgtggatagccaccacgatgtttaaacagcatcttaaaagcttggactagattatggttcaccacaaggaaactagtcgcatcgctgtctttaagatagggatattcttgtttcaactgtttaagcaagtaattcattccatattcatttacaaaatgactgctaggattgttttgatagcgttgcttagccatatctagcatgagattccacactctacggtcattgccgaacatttgccatagttgagcttgttgttgcttgttagggtacaagcgtagcttgacccctttaattaatttggtcattctaatttcacctcctttttgcgttgatcatcaatatacttggctactgcttgttcattaacgctcccaatgctttcaacataataacttggtgaccataggtgacgaccttgctttttccagtagctagtttgtagttctggacattctcggaagaggtgccgtgcagaaatgcctttaagccagcgcatgatgttagttacagacagttttggcggagcgctcactagtaagtggatatggtcatctttaccaatctccatatgagcaatcgtgaatccatattttgaagctatatcatataatgattgcttcaagacttcttctacgtgtcctttcaacactttattacgatatctagttccccaaattaaatgataattaagattgtagactgacgttctaccatatgtaattctttttgtatctttcataccaataattatattacattacggttcgatcatgtgccctaagggcacaaaaaaggcaattcatcacgtccttaaaagaacgtgtttccttgcccgctttcaaaaacggtgcttaaccatgttctacaattcacttttcatttagggcgaactgatttaaaatatagaagtatgctgtatgcaaagtttataagaagaaagaggtcaaacgaacatggctaaattagtactgattcgtcacgggcaaagcgaatggaacctgtccaacctgtttactggctgggttgacgtcgacctgagcgaaaagggtgttgaacaagcaaaagccgccggtaaggcgatcaaggaacacgggctggaatttgattatgcctacacttctgttttgaagcgggcaatcaagaccctccactacgcactggaagaatccgaccaaatgtggatcccagaattcaagacttggcgcttgaacgaacgtcactacggggcattgcaaggcaagaacaaggccgacgccgctgaaaagtacggtgacgaacaagtgcacatttggcgccgttcttacgacgtactgccgccgctgctgagtgctgatgacgaaggttctgccgcaaaggaccgtcgttacgctgacttggacccacgcgccattccgggtggggaaaacttgaaggtcaccctggaacgggtaatcccgctttggcaagacgaaatcgcaccaaagctcttggacggcaagaacgtgatcatcgccgcccacggtaactccctgcgtgccttgagcaagtacattgaaaacatctccgacgaagacatcatgggcttggaaatggctactggtcaaccggtcgtttacgacttcgatgaaaagctgaacgtgctcagcaaggaaaagtacgacattgattaagcttttttaatcaacggaaacgaggccgctcctttaataggggcggtcttttttataaatttatcgctttttgtgaattttttaattataatgaaactctaatcaataaaggaggactaaccaatgaaaatggaagagcacatgcgcaccgacctcaagcgggtcccaacgatgaagatctttgactttgcctttttcacgaagtcaatcgaggggatcgttgaattgaccatcggcgaaccggactttaacacgccggaacacgttaaggaggccgggatggccgcgatcgccaacaaccggactcactacgccccgcagcggggcacggcggggttgctgtcggcgattagtgatgacgtggctaaaaagattggcaaggtgtacgacccggcgaccgagatcttggtaaccaacggggtaaccgagggtgcttacgcggcggtgacggcgatcaccaacccgggcgacgtgatcctggtcccaacgccgaccttctcgatttacatggccgacgccgccattgccgggggcacggcggttgaagttgatacttccaagaccaacttccgcctgacgcccgaattgatccagtcctacctcgatgaatacggcgaccgggtcaagggcttagtcgtggttaaccccactaacccgaccgggatcgccatgaaccaggatgaactagatgcgatcgctgacgtggtgcgcgacaagccaattttcgtaattgccgacgaaatttacgaccagctcgcctacacggaaggagcggatcagtacccgtcgatcgttaagtccttgccggagcaaacgatcttgttgaacggcttctccaagtcctacgccatgaccggttggcgggtcgcctacatgtgtgcgccaaagccgatcaccgatgaactctttaaggtccatggctttgccgtgaccgacgtggcaaccttcgtgcaagacgccgccgaagaagcgctacgcaacggccaagaggacccggcagctatgcgggcccagtaccgggaacgccgcaacgtcttgtatcaagggctccaggagttgggctgggaaaccaccaatccggagggtgccttttacatctttgccaagattccggactacctggaacaagacgacgagaagttcgcttatgacctggccgaaaaggcgaaggttgccgtcacgccaggctcttactttggcgccggtggggaagggtacgtccgcttctcttacgccaccgatttaaacgttatcaaaacggcgctggaccgtttgcaaaaatattgcgccgcccgccggtaaaaatgaaccttttatagcaatttagttaggaaagtgtaaaaggacctgaccgcccgtccccgttctgttatcatagaaagtaataatttttttacaggggagagattgcaataatgaatatactttcgcgggtgccgctcaaggcatttacggctaaactaaaggacctggtcaagccggggtacaccaaggcaatgtggccaacgggtgggttctttttaatctacatcgcattaacggcgcttttggtttacgtggacctgtcctttgtcagcaccttgtacatgaacttgatgatgctgatgtacgggatggctagcacgtcggggattttgatagccctgctggaactgctcggggtcttcgctttgatcttggcgttaggcttttggtataacttcattgccacggcggtggtcttcacctaccaagaccggcttcaacacccggacgtggtggtgagccctagcacgatttggaagaacttcaagcacctgcgtaagaaccaattgtggcggatcagcctctacactggcctgttcatcttcttgtggaccctgccgctgacgatcgtcggtagcttcgtttccaagtatacctgggcggtttacacgatccggatcttaaactacctgatcatcatctggaagtcctacgaatactcgcaagcaacgcttttgtaccgggaaaagcaaccagacttcctggggcaatcgatgcgccacgccctgacggccagccgccgcttcatgggtgggctgaagtttaacttcctcttgttgcaaatcgtcttggtgctgttgccgatcgtagtttggtcagccatctttggcggggttgcttactacgggatctacacggcgacctacttcttcatgtacttaggttacgccctgatcgccttgggaattacggcttacctgccagtgatttacgcaaccagcgctcttttctacgaggaagctaagaagcacatcaaggttgatgccaactttatcggcctcttcaagccggttgaagtgttgaccggggaagccttccaatacggtcacgaaccggtggtcgaagaaaagccaactaaaaaggccaaaaagggcaaggcccaagcggcaaaataatttaggtgagtggccacccaccactgtttaattgaacgaaatcccgaactggatcaaccatgtactgattgatttggttcgggatttttttagtgctttgctctagcttagcccacggcctgcttgataggctggtccacacttcttttaacgtgctcctaaccacgagcctagtgtctaagtacgggcaaagaacatcgcattctgcgataacctttaccctagcttagccatacggctcgtcgaggaggttagtcgcacttctcttaacgtgctccccagccgcaggcctagtggctaagtccagccacagaacaccgctgacgcgctaacctgtgtctaggccttagcccacggcctgcttgataggctggtccacacttcttttaaaatcagggcttcccctcgttgacaattgtaaacggtgctcctatactaaagccaacgttaagatttacagttgtaaacgaaggaggggagccaaaatggtagaagtactcgtcgccattgtgggcctagtgttgatcgccctgatcgtctggtggttctttggtaagcaccaagcgcaagcgggtcgagccgtgatggaaggggatcaccaggtggcgaccgtggtggtcaacggggggtattcccccagtaccgtcgtgttaaagaagggcgttagcgggtcagttaaatttgagatgcgcgattcgaccgcctgcctgtcgcacattgtttttgaacagttagggctcaataaggatttaaccaagcagcccaccaccaccgttgaaattcccaccgaccaagcgggggaatttaatttcgcctgtggaatggatatgttccacggcaaggtaatcgttaaataaggaggaactaaccatgggattatttgatcgttttaagaagccggccgtcaacgaagacggccaacaagttgttaaggtgaccgttgacgggggctaccaaccagaaaccgttcgcttggctaagggggtcccggccaagctggtctttgaacgggttagcgacaagggctgcttggaagtggtgcactcaccggaactgggctttgaagccgagttgccccttaaccaagaagttagcttcgacgttaagaccgaccagcgcggcgaatacggttttgcctgcgggatggacatgtttaagggaaaggtcgttgtaaaataatgaagcatttaaccagcttgaaacggttctgggtctgtttgattctgacgctgccaatgctggtgcaaatggtggcgatgccgtggggttggatgatgccgggctacaactgggttgccctggtcaccaccactttgatcatcgtggtcggggcctggccctactggaagagcgcctgggcagcctttttacagcacaacgccaacatgaacaccctggtggcgatcgggacggcggtggcctacttctacagcatctttgccatgttaactgggcgggaggtctactttgaatcggccgcctttatcaccaccttcgtcctcttgggcgacgcgatggaggaacggatgcaccaaaacgccaacggtgccctcaaaaaactgctcgacttacaggttaaagaggccgaggtcttgcgtgatggcaattacgttaaggtgccactagaccaagtggtggttggtgacttggtccgggtgcgccccggtcaaaaggtgccggtcgatggtgtgatcaccagcgggatgacgacgattgacgaatcgatggtcaccggtgaaagtatgccggttcaaaagggggtcggcgatcccgtgatcggttcaacgatcaaccaagccgggacattccagtttgaagcccaaaaggttggcgccgatacgatgctctcccaaattgtcgagctagttaaaaaggcccaaaccagccacgccccgatccaaaagttaactgaccggatcgcccaggtcttcgtgccggcggtcttgatcattgcgatcgtcaccttcgtcgtctggtttagttggttaaaggcgagcgccgtttctgcaatgctcttcgccgtggcggtgatcgtgatcgcctgtccgtgtgcgttggggctggcgacgccaacggccctaatggtcggaaccggccgggccgctaagcttggcgtcctgatcaagaacggggaggccctggaggcggtcaatgggattaagacggtggtctttgataagaccgggacgatcacggttggtaagccccaggtgaccgacgtggttggtgcagaagacaccctggcggtagcggcggccttagaagacgcctccgagcaccccttggcaatggcgatcgtccaaaaggctagggaagcggggctgccagtcgaaccggtgacagactttaataacgtcgccggcgaaggggtaacggccagattggccggccaagttatccgggtcggcagcgcccgcttaatggcgggcctggcctacccagccgaactgcaagcaagggaacgggccctccaggatgaggccaaaacggtcgtcttggtggccaggggcgacgccgtgattggcttgctcgccattcaagacgttcccaagccgagctccaagcacgcgattgaagagctcaaggcccgcggcttgaagacggttatgctaaccggggacaatcagcgggtggcccaagcgattggtgaccaagtcggaatcgaccaggtcatcgcgggcgttttaccaaacgaaaaggccgatcacgttcgggcgctggagcaaggaggcccggtggcctttgttggggacgggatcaatgacgccccggccttgaccagtgccaccgttgggattgcgatgggcagcgggaccgacgtggcgattgaatctggttcgatcgtcctcgtccaaaacgatttaaacggcgtggtcagggcgctggatatgtcacaaaagaccttcaaccgaatcaagctgaacctcttttgggccctgatctacaacctgatcgggattccgattgccgccggggtcttcgtggccctggggctgcacctgagcccggaggtggccgccctcgcgatggccttctcttcggtctcggtggttttctcgtcactcttgctcaatcgaaccaggattgcgggagtgcaaagggaagtgtaataacaaggattgggaaaatactggaaaggaggtcccttctggtcttttttctgttacacagataacgtgctcccaaccacgggcctagtgtctaagtacggctgaagaacgatgccaaggcatcaaccttcagcctatcttagccatacggcccgtcgagaaggttggcttgcacttccaccctgccgctgggtagcccgccacttctcattcacttatttttccgcggcttgatcatttaaaattctcttcctacaataaccactaacaggagggatttgatgaataaaaacacgagcgccgttcccgccccggtactggccgccgttttggcgaccgggctcttatcctttgccggggtgatcgtggaaacggcgatgaatattaccttcccgactttgatgcgggagtttgacgtttcaactagcaccgttcagtggatgacgtcaatttacctcttggtcgtcgccattattgtgcccctgtcggcaatctttaagcgttcctacccgcttaagcacctcttcttgaccgccaacctggccttcatcttggggatcgtgattgacgctttagcacctaacttttggttcttgctggtggggcgggcgattcaagggctggggaccgggattgccttacccctgatgtttaacattatcttggaacaggtccccaaggagcgggtcggagtcatgatggggctagccaacatgatcaccgggatcgccccggcggtcggcccaacctttggcggggtcgtggtggactcgttaggttggcgcttcgtcttttacttcttagttcccctcttgatgttgtcgcttttccttgggttatgggggattcgtcaggtcagccaagtacaacgggcgccgatcgattggccctcactactcttaattgccgtcttcttcagcggtttaatgatcggcttttccaacctggcgaccaagcccttccttagcctagaagtggcgggcagcctggtccttggcttgctggggatggttggactgtcatggcgctccctttcaatcaaaaaaccgattttaaacctccgtctatttcaaaacgggcgctttgtcggccacgtactgggcttctttttgacccagatcatttcgctggggttcgcctttttattgccgaactacattcaactggtcaaccacaacacggccctgttggcggggatgttggttttgcccgccggggtagccggggcgatctgtggccccctaggcgggcggatgctagaccgggtgggcgcccggcgaccgatcatgctggggattagtgcctgctgggtagccctgctgatctttaccttagtggcccgtcacctggctaaccccttcattgccaccgtctacgtcttatacatggccgggatggggacttgcatgggttcggtaatgaccagtgccttgcggacccttgccgacaaccaacaaacggaaggtaacgcgattttgaacaccctccagcagtttgccggggcggtgggaacttccttaagtgcggtggtggtggcccagagccaaacttacttggcgggcagccaggcctatacaaccgccgtggggacccaaaacgcctttatcatgttgacggtctttgccactgtcatttggtttagctattttaaagttgttaaataaaaaacgggcaccgtcctggcttgcgtcaggggtgcccgttttctttaaaagaccttcatgtcggtccagtgggtcgggaggttgttgaagtcgtaagtggctaggccctcttcaatctgatcgccggtaaacatggcggtgtgggagcgggccaacatcaggttgagttcgttatcggggtggaactgggccatgacgaccgggatgttccaagcccaagcggccccgacctcaaagatggtgccggcgtctggttcggggttgccctcttcgtacttgtagtcggtgatggccaccaccacgtcggcacgcttgacctggcgcatgtcggtggcaaagaccgtgtcctgccagtcgcgggagccaaactctaagccctccgcttggtgttcttgggggttgtaaatgccctccggatcgatggttgggttcttcttgagggctgccattacgatgtcaatccgttccttttgctccggggagaagaaggggctagcgaggtaaactttgttttggtacatgggagatgtcctttctgatcttagtagttctattatagaagaagtgggtacaaaatgcagtaaagaatgggtagaccaatttggttttatgcataattggaaggggcggttgggtgaaacgggagcgccccgactaaaaagggggacagaaagtttttttgcgaaaagttgggaattacacttgcaatttggggtgagggtctgtatagttatatatcgttgtcaccgcgaaacaacgcggtgctgatgcggttgttaaaaataacagttgacatcagttggcaactctgatatagtataagagttgctgatgcaacaggttaacgaaagttgctcaaaaagttaatttaaattaactcttgacagttaaaatgttaactgatatactaaagaagttggttatacaccttgtgagttaatcaacggtagacctttgaaaactgaataatgtttcgacgaatcaaatgtgtagggtccttgatcttaatgatcgaggcaaaaacatttgcgaagtcaattcgcttaatttattaaaaagagctattcaagcttcttattttatatgagagtttgatcctggctcaggatgaacgctggcggtgtgcctaatacatgcaagtcgaacgcgttggcccaattgattgatggtgcttgcacctgattgattttggtcgccaacgagtggcggacgggtgagtaacacgtaggtaacctgcccagaagcgggggacaacatttggaaacagatgctaataccgcataacagcgttgttcgcatgaacaacgcttaaaagatggcttctcgctatcacttctggatggacctgcggtgcattagcttgttggtggggtaatggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctcctttctaaggaattaatcggaaacctacacattgtcgaaacagtgttcagttttgaggggtttacctctcagcttgtactttgaaaactaaataatatcaatttctaataaaatcaagaaaaccgagaacaccgcgttatttgagtttttaacgaattataatcgcatactcaactaacttgactgatctacgatcagtaaggttaagttatgaagggcgcatggtgaatgccttggtactaggagccgatgaaggacgggactaacaccgatatgcttcggggagcggtaagtacgctttgatccggagatttccgaatggggaaacccaatcatcttagtcgatgattacttgagcagtgaattcatagctgccaagaggtagacgcagtgaactgaaacatcttagtagctgcaggaagagaaagaaaattcgattccctgagtagcggcgagcgaaacgggaagagcccaaaccactgagcttgctcagtggggttgtaggactgaactttggagttaccaaagaatcaggtagtcgaagtggctgggaagccacaccagagatggtgatagtccagtagacgaaacctggttctctccgttcaggatcctgagtacggcgggacacgtgaaaccccgtcggaatccgcgaggaccatctcgcaaggctaaatactccctagtgaccgatagtgaaccagtaccgtgagggaaaggtgaaaagcaccccgggaggggagtgaaatagttcctgaaaccatgtgcctacaagctgtcggagcccgttaatgggtgacggcgtgcctcttgcagaatgaaccggcgagtcatgattacgtgcaaggttaaggtggaaaaaccggagccgcagcgaaagcgagtctgaaatgggcgtacgaagtacgtagttatgtacccgaaaccaggtgacctacccatgtccagggtgaaggtgcggtaaaacgcactggaggcccgaacccgtgtctgttgaaaaaggctgggatgaggtgtgggtagcggtgaaattccaaacgaacttggagatagctggttctctccgaaatctctttagggggagcctcggaatcgagaatcttggaggtagagcactgtttggacgaggggcccgtcatgggttaccgacttcagataaactccgaatgccaatgatttatgtccgggagtcagacgatgagtgataagatccaccgtcgaaaggggaacagcccagatcaccagttaaggtccctaaatatatgctaagtggaaaaggatgtggagttgcatagacaactaggatgttggctcagaagcagccatcatttaaagagtgcgtaatagctcactagtcgagtgattctgcgccgaaaatgtaccggggctaagcatattaccgaaactgtggatgtgtccttttggacacgtgataggagagcgttctaagggcgacgaagttagaccgtgaggactagtggagcgcttagaagtgagaatgccggtatgagtagcgaaagacaggtgagaatcctgtccaccgaatgactaaggtttcctggggaaggctcgtcctcccagggtaagtcgggacctaaggcgaggccgagaggcgtagtcgatggataacaggttgagattcctgtaccagttaaatgcgtttgaatgatggagggacgcaggaggctaagcaaaccagacgattggaagtgtctggccaagcagtaagtcaggtttagagtcaaatgctttaagccgggttgacaagctgtgatggggagcgaaattaaagtagcgaagttgccgatgtcacactgccgagaaaagcttctagtgagtatttaactgcccgtaccgcaaaccgacacaggtagtcgaggagagaatcctaaggtgagcgagtgaactctcgttaaggaactcggcaaaatgaccccgtaacttcgggagaaggggtgctggtcgcaagaccagccgcagtgaaaaggcccaggcgactgtttatcaaaaacacaggtttctgcaaaatcgtaagatgaagtataggggctgacgcctgcccggtgctggaaggttaaaaggaagagttagcttcggcgaagccctgaattgaagccccagtaaacggcggccgtaactataacggtcctaaggtagcgaaattccttgtcgggtaagttccgacccgcacgaaaggcgtaacgatctgggcactgtctcaacgagagactcggtgaaattgaattgcctgtgaagatgcaggctacccgcgacaggacggaaagaccccatggagctttactgtagcttgatattgagtgtttgtactacttgtacaggataggtaggagccgtagaaaccgggacgctagtttcggtggaggcgttggtgggatactacccttgtattatgaccactctaacccgcaccactgatcgtggtgggagacagtgtcaggtgggcagtttgactggggcggtcgcctcccaaaaggtaacggaggcgcccaaaggttcgctcagaatggttggaaatcattcgcagagtgtaaaggcacaagcgagcttgactgcgagacagacaggtcgagcagggacgaaagtcgggcttagtgatccggtggttccgcatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcatcgctgggtagctatgtatggatgagataaacgctgaaagcatctaagtgtgaaactcgcctcaagatgagatttcccattcctttggaagtaagaccccacagagatgatgtggtagataggatggaagtggaagtgcggtgacgcatggagcggaccattactaatcggtcgaggacttaaccaagtcaggtgtgaggattcttgataagaaaagatattgtttagttttgaaagcacaagctttcaaagtgtggtgatgatggcctgaaggatacacctgttcccatgccgaacacagaagttaagcttcagcacgccaaaagtagttgggggatcgccccctgcgaggataggacgttgccacgccaactttggaaagaaagtctttcctttctcggtgtcttttgataaaatattaaaagacattgatatgctgacttagctcagttggcagagcaacgcactagtaatgcgtaggtcgaaggttcgaatcctttagtcagcactaattaagactgtcacttcggtggcggtctttttttgtgtttaacttcgaactttttcggcgtgattgttggtccgtaaattgatttcttggtgtggaatttttggtagcggttgagcagccttaaaacatgatcccacttgaattgaaatgacaattccggccagtaatcctttttaacgaaagcgtactggtagaggatgtctaagccgttgtgggtgatggcaaggcagtcgtcgttatgaatttggtgaagtaagcgggcgtctagtaaccgttgggtggttgccaataagttcggatcggtaatcgtcactggcagggttttaaaggggccagtgatcatcaattggcgcctccattggtagtgggtcttgaccgggttagtttcgcccgaggcggtcacaaacaagaaaagtagcaaaaaactagctaggtcaaaggggatggtgtggcaatggtcgctggctaatcgtctcctgattaacttagtaagccgttctgtgttggtcgaattgcgccagtaaaaactattgtaaaagtaggtttcccgctcttggtggcggtgatcagagacgcggatcaccattagttcggcattagaatacagataagtataaatgctattggaacggtcgctaccactggctgagacgattcgccacgcagagtcggtcgataaaagaataagccatccaattctcccccaagaaaataagttagtctaatgaattaattgtacaccttggggcggttgacggcacaacgcccttaattacggtggtaaataaccaccgcttcaaaaaaagcaccggccgcggccagtgcttttttgttgtttttaattcgttgccaacccggcaatccgggcccagttagattggacggtggcgtttttggttggcgtccagaccatgccaccgttagttgattgggaaaccagggcgaccggctggccgttgtggtaggaaaaggcgtaggtgatgtggtattcgccaatgttggttgaagcgttgcagtcgccttgcgggctcttgttgtagttgtacatggcgacgacgttgtaatcgtagttgccggtcccggtggtggaccattcgaaggtcgagccgtccccttcgtaagagccgatcgtgttgttgacgccgccgaaccactggtagtcgcccgggctgagttcggcgtaggattggtgcatcgatggcccccaggagttcataaaggaccgcagttgctgggccttagcggagttccaaggggtgctggaagtggcagctacctggctagaactagcggagctggtctctgcttggctactttggctgctggttgacgaagacgtctgggcgctgctgctttttttagcggtggttgacgagctcgacgccgttttggatgacgatgatgaactagaacacccggccaataagaacagggcggcccccagggtcagggtactggtaataattttatgcatgaaactctcctcccaatggataatcacttactatttctagtttaccctgttgatttgacatatgacaagacgaaatcggttccatcatgtatcctaggggtatcaaaaagaaggaatttgagattatgccattaatgaagtttgacatgctaaaggggcggacgcctgaacagatcggcgcccttttggacatcgtgtacgaggtgcaattagagaccttaggtacccccgtaggtgaccgttaccaagtcgttaaccaacacgaaccctacgagatacacatcttagacaccgggctgggggttgagcgtagcgaccaagtggtggtaatcaccgtcattacccggccgcggacgaccgcccaaaaggaggccttttaccgccgggtggtcgatcgcctccacgacgaactggggatgcgcaaggaagacgtgatggtctcaatggtccaaaacaccgatgaggactggagtttctttggcggtgacgaccagtttttgaccggggcgctatagggcgccgtggtgaatcgtgatttggcggccccgcacgctggtctgccctcggtaaccagttgcttgaggcaacggcttaaggtggccggcgtgatgcccagccagttagcgacctcgcccttggtcatcgctagctggtaggtgctggggggactggcgatttgcgcgattttagtcagggagctggcgggtaaattacgaaaggcccgcaccgccccgcagacggtcaattaaagtttccacgatgagttctccttttgacataaagcaaattgggcttagaataacctgataacgtaaagaagtaaagcatttcggaggtggattatgcaagttgaagacgcccttaaatcccgccatgcggtacgggattttaccgaccaacccgttgcaaaagaaacgatccaagaaatcgtgcgcttagctcagcaaacgccgtcctgggtcaactccgagccctggcgggtgtacgcggcgaccggccagtcgctgacccaaattcgccaggggtgtttagacctggccgcccaaaaggtggcaaccaacccggaccttaaaacgatgagccgggacgactgggatgcccggccgcaaaaactgatgaaggactggggtcacgacctggtgcattactttaccgactttgacgaggcccacacggtgatgaccggggccagcgacgccttgaataacgccccggcgattctcttcgtcacgatccctaagcaaacgccggactgggcgatcctagacgccggggccttcatgcaaagcctcttgctggcggcgacggccaaggggttggggtcgattccaacctacaacagcgtccgctacccgcaggtggtccgccaagtactggggatcccggaaacagagcggctcctggtcggggtcgagctcggctacgaaagctcggccaaggtcaatgcctttcgggcccagcgcccggacctcagtgatgttttaaaaatttcagaataggggcgatgattactatcatccaatacaaaaccgttaacgtcgacggcctcgacgtcttttaccgtgaagcgggcgacccaagtaagccggcctttgtcctcttgcacggcttcccgtcgtcatcgagtatgtttcgcaatctaatgccgctgttggcccgtgatttccacgtgttggcgccggatttgatcggttttggtaactcggcagcgcccagtcgcgaatcgtttgagtatacctttgagaacctgaccaagaacgtggccggcttcttagccgcgctcaaggtcgaccaatactttttgcatgtctttgattacggcgccccgatcgggtttcgcctggcgatgcgccagccagagcgggtgctgggcatcgtcagccaaaacggcaacatttaccaagaagggctggggccgaagtgggcagaacgggctaagtactgggccaatccaaccccggaaccgcgggcgcaatacgaaagcgcctttgccccggagacgattaagggccagtatttgaccggcgaaaagcccggtacggtcggcccggatggctttccttagacatcgcccacaccacggagccgggttacgcacagcgccaagacgacctgatcttcgattaccagaccaacgtcgccttgtacccgcagttccaagactatgtccgccagtaccagccggaaaacctggcggcttggggcaaaaacgacccctcttttatctacccgggggcaccaaggtcttaattgcgattgcgaccggcctggccgccatggcgcgtttaaaggccgcccatcagcagctgaaggaggtcgccacggcgttgagcacgaccccggaagaggtggtcgccgccgctagcgacctgctggccaaaaacaaggccctcaaaaagcaacttaaggccgctaccaaagcgctaatggcccagcaggcggcgcaggtgctggccagtggccaacaagtcaacgaggtccatattgaaagcgccggcgacatttcggtgttggcgccgttagtcctaaagggggctggcgaagaaacgctcctgtgggccaagctcaacgggcggttgtacttcgccttgatctcaccggcggggcaagcccgtacttacctgactaagttgcaagcgctaggcgaggtccagggtggcggctcgcctaaggtggtgacgggcaacacgaccctgccgctggaacgggtggcggagactattaattaaagaagtgcgacccaaaaaaggagaccgagagaaaaattctttcggtctcctttttcatttcttgacggttgtacagataacgtgctccccaaccgcaggcctagtggctaagtacggacggagaacagtgcgttccgcactaacccccgccctagcttagcccacggcctgcccaatggttgggtcgcacttccctttaaattaactgcctcaaccgattcatgaaatcctggactagctggggggcctggcgcgaggccaagaccccgtagttgacggtgagcggcgtgtcgagcagcaccgtgaccaagttggggtggaggtcttgccagggggtgaggttgagcagggcaaggttttggtcggcggcccggttgaagacgtcgaggttgtagcgcccgcgggttccttcaatgattacgtccggggcggccgtttcaatggcgtccctgagctggtcgtttttctcgctaattccacgggggaccatcaagaggcgctggccggctaggtcgttgagggcgagcctggaatgatgggcgaggggatggtcgctggtgacggcgatgccaaagcgataggcgcccagggggacggcgacgaccagctggcgggtggttgcctgatcgaaggtaccgatcatgatgtcgcgctcttggccgagcatggcgtactcgcggttggaagaggccgcctcgccgctgagctgggtgaccgttagtggggcggctttaatctggttccaggtggccatgaagggggcgctggggtgcatcaaagaagtgcccagccggattacctggcgctggccgctatactgatggctagccaccagggcctggttgactaagttgacgatttgttcggcgtagcccttgaagcccttgccggctggggtcagggtgaccccggtactggtccgggtaaaaagggccacgcccagctcctgttccagcttattgatctgtttcatcaccgccggggcggcggttaaagaaagcggccttccccgcgaagagttattcatcaccactaaggcgatgacgaccggctaccgggccaccaagctggggatcgacaattccctcactgaggccgggctggactactttgacttgatgctgatccactggccgatgcaagacgacctggggacttaccgggcgctggaggaagcctactaggccggtaagctccgttcaatcggcgttagcaattttaaccgtgcgcaactgggtgaaatcatggccaacttccaaacggtaccggtggttgaccagatcgaaacctgtgtcttgcgccagcaaaccaagctccaccagtacttagccgatcaccagattgtccacgaagcctggtccccactgggtgagggcgccggacggttattcaaccacccggtgctaaaggacctggccgctaagtacgatcacaccaccgcccaggtgatgctacgttatttgacccagcgccagatcatggtgatcccgcgctcaaccaatccgatccacatggccgctaacctcaacatctttgactttgccctaaccgcagccgacctcgcccgggtgcaagccctcaacgagaatttctcgctttccggctggccgtccagcatgaccttggacgaagattactaatgtgttataattggataaatgatgtaagaagtagcggatcacaactgaggaggaattttatcatgtcagataatggaacagtagataaaatcaagggcacagtaaaagagaccgcaggcgatgttactgacgacaagaagctgaaggccaaggggatcttagataaaaccgtcggcaaggtaaaagaagccgcagaagacgtgaaggacactgcggaaggtgtcgctaaggacatcaaggaaaaatttgataagtaatcttaaaaatcaggggtaaccaaggacgctgaatgtggtacactgaaggcattatcaagatgcaaaagtgtgtcatagggggttacctccagatacagcaaaagtccggtgcgttggtgctttctagccagcaagccggcttgggcgcccccatcggcgccttttttatttccgaatttacttgacctcaagttaacttcaggtgctaggttgatgataacggatggttgaagtagaccttggaggccaaaacaacttggtcgcgggcgacgtctttaagcgcccggcccaggtattcttcgctggtcccgtaggagtagacgttggcggtgtcaaagaagttaattccgacgtcgagggcgtggtggatgatgcgatcgctcgcttgttcatccaaggcccaggagtgggtggagccgtcgccaaagctcatgcagcccaggcagagtttagagacctgaatgtcggtgttgccaattgttgcatattccatggttattccccctatcaatttaatgattattatacccttgtcatttgccggttggtcaggaataatgaaggggaatgagaggagcgaaggaattgaatatttggctgttgacggtcacctttttagcggtgaacctcgacttttttgtgttactgctgtttttattgaagaaattctcggtccgccaggtggtggtcggctacttgagcggggtggtcttgctcttggtggccagtttcttagccggcaaggtcttagcccagtttttgccggagtggttgctcggggtactgggggtcttgccgatctacatggcccttcacgacgaggatgatgacgacaaggccgaactaacgaccgcccacggcacctggcaggtcttagctacctacctggccgtttgtgcgggctgtaacctatcgattttcttgccggtcgtggccggcgaatcagtggcggtctttggccgagctttgttatacctgggcgccctgacgatcttggtggtctttttagttaaggccgttgaacgtcaggccacggtgaccaagctaattgaccgttacggcgaagggctgatgaagctgtgctacattggggtcgggctctacgtcttttacgactcggggctggtgacccatttacttaaattaatttaaaacaacgccccgtggaaaagatctccagcggggcgttgctattttaataaatattggccggaaatcccgtgactttagtcatgggatggataggcttctacttacgtcctttagggcgtttttttatttcattgtacttttgattattgatatattgctcaacgacctccttgctcatattccctaaagtactcatgtaatagctaggggaccagaggtggccaccccaatactgcgactggcggatttccgggtgtcgcttgaggaaaatgaaggcactgcgtcctttgagggctttgatagcgctagttggtgctttactaggtggaaaactaatcaacacatggacgtggtcaggcattacttccatgtgctcaatcacgatttcgttatctgccgcaaccgttgtaaggatttctttcatttcattcactaacgcttcactagtaaaagttggattacgatacttggttacccaaatcaaatggtagtgaaagttataaatataacgccgtgtataaatggcatcttcgattttgtccttcgacatgattgccacgctccttaattattattgtcattgacatgtggtataataacactatattagtgaaggaggtgaaaataaatgaagtcaatggcgcagatgaaatgtcattacggactcaaggtgcggatttatccaagcgacaggcaaaagaaaattatcaagatcaatagtgatgctagtcgcttcatctataacgaaatggtcgctattaacaaggaactttggcggctaaaacaggttaaactcccgattgataccattcagaaccggattgagcaactggagcttcgccaaagcgctaaacaaatgtctaatcatttccagttcttagaagataaaaggatcgatagcttgactaaagccaatgccattcaaaactaccataaagcttggaacgcttttcgcaaagttcataccgcaggtgtgcctaagtttcaccggaaaagttacgtctggcgttatcaaactaactgccagtatttgaaacagaaggcagcatacttaactaacggaactgtacattttgaagatagtaagcatgtgatagtgcctaaattaggtcggctccgtgttaaaggttcccatcaacgagtcttagctcgcagtgctgaaacccgtattggaacggtaaccatcgtaaaggacgctagcggtcgtttctttctctcaatgcagttagcgtcggatactccctttgtcaattggccgcaaaatacaggcaagcagattgggattgatcttaatactgaaaacttcttaactactagtgatggcgatactgtggctaatccacgctattaccgcataattaagggtcgcttagccaaagcacagcgcatcttatcgcgacgggctcgtcgggccaaacaagaacatcgaccattacggactagtaagaactaccaaaagcaacgcttgttggtggctaaattacacgcccaagtctttgaacgtcgacgtgactttctccacaatgtctcgactacactaatcaagaaccacgatttcgtagccgcagaggaattgcggagtaaaaatatgctgaagaatcatgctttagcgatgagtattgcggacgtaggttggcggactttcttaggaatgttggcttataaagcagaactctaccatcgccaattccttacggtgaatcctaagaacactacgcaggcttgccatgaatgtggttttgtgatgggcacagcagggaccgaaaaactcacacttgcagaccgagaatggacatgcccaaagtgccatgctcaccacgttcgtgaccataacgctgcgcagaatattctaactaaaggaattattaaattagcctaatttggctcgtccctatggcaacctggggacgctaaaggcattggtaattgccgtgtaagacgaaacggttcgtagaactgttcgcagtggtgtatctatgcaaattgtgattcaaacactcatcagaagggtgcttgctcacaagccactgactttagtcagtggtggttgacccatgactgattaccaagaacaactcgccgaatgccaagccaataacaagaacctgtttgccagtgtcggcgaggccgggaagggctttggcgccctgcacgccgccagtgttgctgacggggtgctggacaccaagactaaggaactgatgtcgctatccatttcggtggtcgaacgctgtgagggttgcatcacccagcacaccgccgcttgcatcaaggccggtgctagccgcgaagaattcgctgaggccgttagcgtggcgatcatgatggctgggggcccggctacggtctacgggggcaaggcgctggtctgctttgaccaactcagcaagtaagggctttccattttcaaccagacgtagtacactagacacgaagaattggggtgccgtttggctgagaaatacccattgaacctgctctggttaggaccagcgaaggaaattctcatcattaataccatcagtcccaattgggaaaccgataacgtgatgacctcaattctttagtgaattggggccttttttgtggcccggcttgttaggtgagttaccgtgcccttctgttacttaataagcaaaaagcgcccgccccgtcaaaactgacggaacgggcgtttttcatttggggaggttgggtcgcacttctttactaagcgtgcttccgcttcatcattgggtagatccccagcgttaagatggctaaaccaagggcaaccaaggcgctttggttttcgttaccagtttgtggcagggtcttagcagtggttgaagaagcaggggtgctagacgttgccttcttagtggtagccggagttgcgacaacggcgctagttaccatggtcgttgaagcgctagaagccacgttggaagtggcggttgcggtactagcagcggagttagttgctgaagaagcagcggaacccgcgctagatgcggtagaggaagcggaggatgccgcacttgagtccgttgaggaagcagaagatgcagcactggaagcagaagatgcagcactggaagcggaggatgcagcgctggaggctagcgttaccaccacgatgttttgggcggacttgagttcagcttgggcgctggttaaagcggcgttggcactgtccaagttagccttagcagttgccaaagtagcgtcaacggcggattgggcagcttgagcgctagtcaaagcggcttgagcggtgctgtttgcggcttgggcgctggtcaggttagtagcagcgctcgtggcaacaacggcggcgtcggaagcaaccgtagcggcggcagtggcagcggaagcggcgctagaagcgacttgggcaaccttagcggcgttggtttcagccgtgcttaaagcagcttgggcgctggtcagggcagcatcggcttcagacttagtagctagcaagccgttgaagatggtggtattaacggcatcattaaccacgtcactggttgattttcccgtacccgggaaaaccgccagcgccgtttggttcatcggaccctgcggggtctgcaaagcaaagcccagggtggcactccccttggccaagacggcggcgctcaccttgtaagtgtaggtcccggtatcgccgttagcggttgtggccgttggctgttcgccgttgagggtcatcgacttgatgtagccgttcccgctggacaaagtgatggtgatcaggtagtcactgccgtcctgtttgatcgtcacctgcttggcaaagaaaccggccgccatagattgctgggtcgggtcactggacttcatcaggttgaagttggcggttaccgtttggcctgcttcagcggaagccaccgcgctgtcagcgtcagatgccttagcggaggcagaagcaacagcggattgggcgctaacaacggctgccgaagttatggacttagcatggctagttgcggcggcggtggattgggccttagcaaggttagcatcggccgtggacttagcggtggcagcagagtcggcggcggcttgggcatttgctacggctgaagaagtagcagcggcactagcggaagcggcggcagtcttggcagcggcgtcagaagccgccgtggaagcggagccgtacgctgcttgggcggaaacaacggcggcggaagcggagttcaccttggcttgagcggaagcgatcgccgtgtccttggtggcgctggtcgtggtggtcaccggtgcagagctggtggtgtcggccttaaccgtggtggtgttgaatagggtagtggctgccagggcaccggcgatggcagcggtggtaaccaaagtatttttaacgtgtgaagtcatggacaaatcctcccgaattgatcgattattaattttgaaactgctctaattattgcagataaatttaataaaaacaacattaaaaaagcaaaaaatggtatcatgatcttaacgaaaattgagggaatgaccctttcaaaacgttgtcaagtcaacattttgtgacacggtgtcattttggaggaagttataacaatgttaacaaatagacgattggtttatcgtttgatacaagcgataatggcggcgaccctcactgtggggatcgccgctcctgccgtggtaacactgggcacgacacccctggtggctaaggccgctgatcagaagtatcaggatggaacttacgacgtgcagacgtcctttaaaaagcaagacgaccagaaccaggactccctggcccagggctttttaaataagggcgccacgctagtagtggaaaacggtaagctccagctgaagatcacgaccaccaacgacgggggtaaatacattaaggatatgaaagtcgacgggcaaaccgagtacgctacgatcgaccacgacggcaacaacgccaccatcacctttaccctgcctaacaccagcggtagctacctgatcgacatgaacttgaacacgccgatgggggccatgagccaaaaggcctacttaaaggtcgacttttcgaccgttaagacccaggcgacggccagctccagttcgtctagtgccgctagttcagcttccagcgctagtgctagtgcggctagctccagcagttcgagcgccaagtcggcaacggctagctccagtgccactagttccagcacccaagctagttccaccaaggcgagttcgaacacgtcaacgacccagcctagttcggccaccaataccgataacgctgaaacccgggtcctttcgatcatgaagtccagtgacccgacccagcaatctgcttcggccggtttctttgccaagcaggtgacgattaaacaagacggcaatgactacctgatcaccttcactttgtccagcgggaacggctacatcaagtcgatgactctcaacggcgaacagccaacggccacgaccgctaacggcgataccgggacctacacttacaaggtgagcgccgccgtcttggccaaggggagtgccaccctggcctttgctttgcagaccccgctgggcgcgatgaacgaaacggcgctagcggttttcccgggtacgggaaaatcaaccagtgacgtggttaatgatgccgctaagaccacgacggacgaaccagtaatacctactagcaacggccctgtgattgacaccaccaaggaagtccaagacgtggaatacgaggtcttaaacgccgccaagtccggggtgtctgaggccaacgcctactacacccacactgcccgggtcaccaagtccggcagtggctacaacgtcaccctgacggtcaaggttaagagcgggatcgtttcctttacgccactttctgtgggcgccggtccgatcgttaacaccaccaagacgagcagtggcggcgatgatatctggacttacaccttctacgtggccgacccaaccgtgctagacaatccggttgccgcttcgatccggatgagcgtgccgatcgccaacatctccaaccagaccttctcgatttggctggtctttggcaagacggcgacgaacaccaggagctacctggatgcgctgtcgggcgacgggacctccgggggcaccttaaccagcaccggtttgaccgggtctggtagcgccactccgctcgccggcagtgccagcccgatggcgaccgccctgcaaagcgggaccgggacggtgcaaaactttgacctggccgcggcccaaaagaagcttggcaagtacgcggtcaagcccggcgtctccaagatggtcgaagcctcgctgattaagtacccaattgcggccgccttaaccttcttcattgtggcggcgctaattgtgattggggtggcgaccacctggcggcaacgaatcgtgaaaaaagtaaggggattaattcatgaagcttaagcaatttttattaacggtgtgcaccctgatcgtagcggtgatcggcttcgccaaggtcgggcacgcccaaagcgttagttaccaaacctacaagtacggcacctccactacctcgatggcggacggctactacgcccgccccgccacggtaacggtgtcaaacggcgcctacgtggttacgatgaccattcggaccgccaccaacctatcggcctggccggtcgtcgtcaactccatcgacggccaagccccgcaaaacgtcactaagacccagagcggcggttactacctgtacagctactcctttaccaccaaggacttaagcggggtgatctccagcagcatctcgatcaacgtaccgggggtttacaaggccaaccacaacatttcctttaagtttgacacctccagtttaccggccctgtcggggagcactagttcaaccagtgccagcggcgccaattccagttcggccaccgcggcggcgggggtggccaacgggtcgtctagttcgaccagcggtagcaacgacccccagctaagccaaaagcttaaaaagttagaatcgcaggcctcctcgcaatcgtcagctgccaaggccaaggaaagccggctggcccgctccacgatcgcccaaaacgaccgggtccaagaacaaagccaaaagaaccagaccctctactacttcgttttagtcggcgggatcctggggctcctgatcgtgattgcggccgccgtctacttcgtttggtccgctaagaagcaaattccgcgccactaaaggaaaagatcgttatgaagaagaaatcaattattatctctttgctcgtcgccctcgtggttgtgattggggtggccgtcggggtcaaggccttcgttgaccaccaagccgctaaaaaccagcggatcgtggccaccagcgccgcgattaccgaaatctttgacaagttagacatcgacctagttggggtgccaaccactcaggctaagttgccgagccgctacaaggacgttaccaagattgggagcccgatggacccgtccgtcgaaaagatcgcttccttaaatccgaccgttgtttacgccgtttcgaccttaaaggaccagtacaacgacgccttcaagcaacaggccgtgaaggtgacctacctcaaactcgacacggtcgcccaactgaaggggactctgaccagcctgggcaaggaataccaccgcaccagccaggcccaggcccagatcgaaaagattaacagcgccattaccgccgtcaaaaagcggatccacggtcaaaagccgaaggtgctggtgttgatggggatgccgggggccggttacatgattgccaccgataagtcctacgtcggcgacctggttcggctggccggggggcaaaacgtctacgccgctaacggccagacctacatttcacccaacaacgaatccttggcgaccaagaagccggacgtgatcttgcgcttggaacacgccttgccaaacgtcaccaagccacaattcgaaaaagaattctccaccaacccggtttggaagacgatgccggcggtcaaaaacaagcgggtttacgacctccagcaaccgacctttaacgcctcggccaacatgaacgccgccaaggccttaaagcaggtcagtcagtggctgtacccaagtaagtaagatgaaacgttccgctatttcctacctcgtcctcgctgttttgttggtggtcacggtgtggatcgccctgactaacggggccagccacttcagcctcttgaagatgacggccaccgacgccaacaccctctttaacattcgcctgccccggatcatcaccgctttgatggccggggcgatgttgtcagtcagcggggccttcttccaggccgccttgcgcaacccgatcgccgaccccgggattatgggggtttcagccggcgccgccttgttcgcctttgtcggggcacttttgttgccaagttttttctttggcaaggtcgtcttcgcctttgtcggcggggccatcgccctaggggtgctaatctttttccaaccgcaaatggacccataccgcctaatcctgatcggggtggccttaaacgccaccttcaccgggatcgccagcgtcttttcgtcgaccagccaggtgtcgttaggaacggtgacctggctcggctgcttgaccgtgaccgtgctcgggatcctcggcttaatcggggtggtcttggtcaccaactggggtaactacctcaaggtgtctgacgaacaactccgctccctggggctgtcggccggtaagttacgcttggccctgctcgggttagccgttttcctagccaccacatcgaccgccgtgatcggggtgatcgcctttatcgggatcatcgtgccccacgttggccgggtgctggtgggccgtgactaccgggccgtggtgccctttgcggccctggccggcgcctggttgatgctggccgttgataccattggacgcctggtgatccagccgagcgaaatcccggccgccaccttgttagcgatcatcggggggccggttttaatcttcattttggcccacaagaaggggggtgcccgccatgtttaagcttgatcacgtgacctttgcctacccgcatcaagccccgttgattcaagacctgacaatcggggtgccgaccggtcaattaacctgcctggtgggccccaacggttcggggaaatcgaccctctttaagctgctgacccgtagccaaaagccccagtccgggacggtgaccatggacggccaagacgtctgggcctattcgccgcgggagtttgcccgccaggtggcgatcgtccaccagcataacccggtttacgacgaaattaaggtccgcgacctggtggtgatggggcgcctgccctaccaatcgctgctcagcgactttcctgccaccgacgaaaagggggaggcgatcctggccgaactaggcttaaccgacctggttgaccgcccacttttgaccctgtccggcggccagcaacagttggtgtggctagcggccgccctcaaccaagacgcccaggcgatctttttggacgagccgaccacctacctcgacctccacttccaggttaacttcttaaagctcttgcaacggatccaagcccagcgccagctgacgatcgtgatgatcatccacgacttaaaccaggccctccagtacggccaacactgcctactctttaaggaggggcaagtggttgacagtggggcgcccgaacaagttctgagcgccgaacgtgtgagcgaggtctttaacctcgactgttaccaggtggcgacgccggcggggatgaggttgtttcaaaattaagaagtacgaaccaacctccacgctagtcctagctaaataaaaaccgtcaattcgcaaatttgattgcggattgacggttttttgtttggggtaattttttaactattccacagataacgtgctccccaaccgcaggcctagtggctaagtctggccaaagaacggtgctggcgcaccaaccgttcgccctatccttagcccacggcctgcttaatggttgggtcgtacttccagataacgtgctccccaaccgcaggcctagtggctaagtctggccaaagaacggtgctggcacaccaaccgttcgtgctatccttagtccacggcctgcttaatggttgggtcgcacttccttttcctaatctttatccagcgccgagacaccctttttgatcatgaagatgtaaaccaagagtgagataaagacggtgccggaaacgtaccagaagaagccactttccaggtgaacggagcgcagccagagggcgacgtagttaacggttcccccgaagatggcaacggtcaacccgtacggcaggccgacgcctaacgcccggatttcggccgggaagagttcggccttcacgatcgcgttgatcgaggtgtacccggaaacgatgaccacgccgactaacatcagtaagaaggcttgccaagcttgggtggcgttgttcaagagggtgaagagcggcacggtcaagacggttccgccgaccccgaagaagatcaagagcggcttgcggccaatcttatcggataagtgaccgaagaccggttgcaagattaccatcaccagcagggcgaggaagttaatcatcgccgcactttccttagacaggccggtcgtgttgatcatgaactgttgcaagtaggtggtgtaagtgtagaagctgatcgttcccccgagggtcatcccaacgacgatcaggacttgcttggggtacttagccaacagccgaagagtgccggcctgcttgtttttcttgttggtgctgttgaattgatcagattcttccattgaaagtcgcaaccacaagaccacgagcgctcccagggccccaatggcaaacgggatccgccagccaaaggcgtagagctgggcgttggtgaagatgttttgcaagatgatttgaacgagcagggctaagagctgccccccgatcagggtgacgtattggaacgaggagtagaaaccacgccgggaaggggacgccatttccgacatgtaggtagcactcgttccgtattcaccacctaaggaaagcccctggatcaaccgggtcaagaccaggatgactggtgaccagatcccgatttgggcgtacgtgggcgttagggcaatgactaaggaaccaccggccatgatgatcaccgagagggtgagggcggcccggcgcccctttcgatcggcgaaacgccccatcacaaaggaacctaaggggcgcatgaagaacccgatcgcaaagaccccggcggtggctagtaattcggcggtttggttgccagccgggaagaaggcggccgagaagtaaatcgcaaaggaggcgtaaacataccagtcgaaccattcgaccatgttgcctaaggatccttttaaaatgttcgtggcgacttgacgttcactgcgtgggaccgtccggacagtggttgcttgagctcgcatgtaaagacctcgctttcaaaaattagaatagtactagtataacggttttcttaaaggaaagtaagtctttgctaagaaactcgttagaaattaagttttttcacttaatgaccgatgattataaaaacggttccgctcccaggcttaatgatcaaaagttgggaaaagattttgatatgaattccaattgtaataattaatgataagcgtttacaatgttgatttaacggttatgaaacgatttttaattatggatataattgacaatctggaaactgtgtaaaattgttttaatattacgaaaaagctatagtggtattaataaatacgatgggagcagttccatttaaggtaggatattagtagtgtcaagaaataatcagcggatcaagattgagcggatgttgaatcaaaagcagcgttttgggattcgcaaactgagcattggcgtagtgtcggtgcttttaggaaccatgttcttcctcggcaacggggtggttcatgccgatacagtttcgaactctcagataacgacaactagttcaacacctgcttccagcagtgatagtaatagtagtaacgtgacgatcaccagcagtgagacgggttctgcggcgtcttcgtctacgtcttgggcgtcgacggctacagcatcggtgccatgaacggggcgacgttatcaacccaaattacgttcgtgataggggaggatgggacgacggggaaggtggtagaaatcgtgccggcccaaacgccaaccgccaatgagaaggattacacttgggaatacgtctacagcccgaaagcccagtcctttaccgtcacctacgtcgatgacacgaccggtgaggaattaactgaccacgacttcaccctgagtggggtcacggacagatcctacgccaagaccctggccagcgacaagtgggactacgcggcggccggctacgtgctggatacggaccagaacgccactgacccgctggacagcctgagcgggacctttggcgccacgaacgttaacgtagtggtgtgcctaaagcacgggacgaccacccaagaagaaaccgggacctcaacttacacggtcaattacaccggcgccgctaacaacccaaccagccagccccaaacgattgactacacccggaccaacacggtcgataccatgaccgggctcgtgacggcgtatggcgactggagtgtgaccggcgacaggaccagtttcaccagcatcacgaccccggtcgtgactggctacgtggccgacaaggcaagctcgacggttgacaacgccacgccaagcgagggaaccgccgaaagcgacacggtcacctacagtccggtcgggaccgtcacgatcaccaagccgggtgggaccgcgacgaccgctgcatacactaatgaccaaaatgacaccaccaaagtcacttcctttagtgtacccgcggtggcggggtactcagcccaagtaacgggtgccacccttcaatcggacggcacctacctgccggacagcccgacccaagcgtccaccgtgacctacacggccgacccgcaaagcttcaccgtcacctacgtcgatgaaacgactaacacgaccttaaccgaccacggtctcaccctgaccggggtgaccgccggctcctacgccgaccagttggccagcgataagtgggactacgcggcggccggctacaagctagacacggccaagaacgccacggacccgctaagtgaattgagtggaacctttggcgcccaaaacgcgggcgtgacggtctacttaacccaccaaacgtcgaccacgacgcaaacacagaccatcacccggacaattaactacctcgatcccaccaccaaggagctgacttcgctcacccaaacggccgaactcacccggacggttgaagaggacctggtgacgggtgcaaagacctactcgcagtggaccactgccacgtggccaagcttcaccgttccaagcgtggccggctacacggccagcccaacggtggtgccggcgttagtggttaaagacggcgatggcgacgtcaccgtgacgatcgcctacaccaagctggtaccaaactcgagcgcggcttcgtcttctccggcgagtgcatcaagcgcagcgcgacgccaacctcggctagcgcgggctctagcgctgccagcgcagccacgaactccgccagtgccgtttcggcggctccggcggcggtaacaaacacggcgccaacgtcggccgctaaggcaacatcggcggtaagcgagcagaagttgccacagacgggcgacgacgagcaagccgcattgagcctcaccggggtttccctgttgagcctcttgactctactcggggttgggcgcaagaagaagcgtcattccaggaactaagctgaaaggcagatacaactagcaaacggacgttaggagactagcgcccgtttttttgcgatcaccagaagggcgctgccgttttgatcgcggtataatggagagattaaagacaaaggggacgcgatacgatgcgctttatttcatggaacattgattcaatcaacgctgctttaaccggcacctcggcccgggccgaagaaacccgcgccgttttggaaaagatcaaggcggccgctccggacgtgatcgccattcaagaaaccaagctctccaagagtggaccaactaaaaagcaccaggaagttttggcggagctgtttgccggttacacggtcgtttggcgctcctcggtcgagccggcgcgcaaggggtacgctgggacaatgtacctatataaggaaagtttgacccccaaggtgacctacccaacgattggggccccggagccaatggacgaagaggggcggattatcaccctggaatttgaaaacttctatttgaccgaggtttacaccccaaactccgggaccggactcaagcgattggccgaacggcaagaatgggatgaccgctaccgggagtatttaaccgaactagatcgacaaaagccggtgatcgccagtggcgatttcaacgtggcccacgaggaaatcgatttggcgcacccggctaataaccaccattcggccggctttaccgatgaggaacgagagaagttcacggccctgctggcggccgggtttaccgactcctttaggtccctacacccggacgaaaccggggcttactcctggtgggcgcaacgggcggtcaccagtaaggtgaataactccgggtggcggattgactactggctagttagcgaccgtttggccgaccaagttgtttcgtcaacgatgatcgattccggtgaacgacgcgaccacgcccccattcaattagatatcaacattccggctgccgattaggcattagggctcgcatcgttggtggtgcgggcttttttagtggttgtttaacggtggggcgccctgtctttaaggacctgcgaaaaaagttaaaaaagttttttgccgaacaattaggtggcggggttcgggtttggtcatctcgttggtcaatgatagcggttaatgttcgcataagtgatgaagaggaacgcgtggagggagcaaaaaccgatctttaattggcggaggagagatagcgggtcgaaatggacgcttgacgggtggggttgaagtgagtatagtaacaactgttgtcagcgaggcattgcttcttcgctagcaacgcaagttaaaaaagttgttgacattcaaatcaaatgttgatatacttaaaaagttgtcgcgttaaggcgttggcaacggtagacctttgaaaactgaataatgtttcgacgaatcaaatgtgtagggtccttgatcttaatgatcgaggcaaaaacatttgcgaagtcaattcgcttaatttattaaaaagagctattcaagcttcttattttatatgagagtttgatcctggctcaggatgaacgctggcggtgtgcctaatacatgcaagtcgaacgcgttggcccaattgattgatggtgcttgcacctgattgattttggtcgccaacgagtggcggacgggtgagtaacacgtaggtaacctgcccagaagcgggggacaacatttggaaacagatgctaataccgcataacagcgttgttcgcatgaacaacgcttaaaagatggcttctcgctatcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaatacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctcctttctaaggaattaatcggaaacctacacattgtcgaaacagtgttcagttttgaggggtttacctctcagcttgtactttgaaaactaaataatatcaatttctaataaaatcaagaaaaccgagaacaccgcgttatttgagtttttaacgaattataatcgcatactcaactaacttgactgatctacgatcagtaaggttaagttatgaagggcgcatggtgaatgccttggtactaggagccgatgaaggacgggactaacaccgatatgcttcggggagcggtaagtacgctttgatccggagatttccgaatggggaaacccaatcatcttagtcgatgattacttgagcagtgaattcatagctgccaagaggtagacgcagtgaactgaaacatcttagtagctgcaggaagagaaagaaaattcgattccctgagtagcggcgagcgaaacgggaagagcccaaaccactgagcttgctcagtggggttgtaggactgaactttggagttaccaaagaatcaggtagtcgaagtggctgggaagccacaccagagatggtgatagtccagtagacgaaacctggttctctccgttcaggatcctgagtacggcgggacacgtgaaaccccgtcggaatccgcgaggaccatctcgcaaggctaaatactccctagtgaccgatagtgaaccagtaccgtgagggaaaggtgaaaagcaccccgggaggggagtgaaatagttcctgaaaccatgtgcctacaagctgtcggagcccgttaatgggtgacggcgtgcctcttgcagaatgaaccggcgagtcatgattacgtgcaaggttaaggtggaaaaaccggagccgcagcgaaagcgagtctgaaatgggcgtacgaagtacgtagttatgtacccgaaaccaggtgacctacccatgtccagggtgaaggtgcggtaaaacgcactggaggcccgaacccgtgtctgttgaaaaaggctgggatgaggtgtgggtagcggtgaaattccaaacgaacttggagatagctggttctctccgaaatctctttagggggagcctcggaatcgagaatcttggaggtagagcactgtttggacgaggggcccgtcatgggttaccgacttcagataaactccgaatgccaatgatttatgtccgggagtcagacgatgagtgataagatccaccgtcgaaaggggaacagcccagatcaccagttaaggtccctaaatatatgctaagtggaaaaggatgtggagttgcatagacaactaggatgttggctcagaagcagccatcatttaaagagtgcgtaatagctcactagtcgagtgattctgcgccgaaaatgtaccggggctaagcatattaccgaaactgtggatgtgtccttttggacacgtgataggagagcgttctaagggcgacgaagttagaccgtgaggactagtggagcgcttagaagtgagaatgccggtatgagtagcgaaagacaggtgagaatcctgtccaccgaatgactaaggtttcctggggaaggctcgtcctcccagggtaagtcgggacctaaggcgaggccgagaggcgtagtcgatggataacaggttgagattcctgtaccagttaaatgcgtttgaatgatggagggacgcaggaggctaagcaaaccagacgattggaagtgtctggccaagcagtaagtcaggtttagagtcaaatgctttaagccgggttgacaagctgtgatggggagcgaaattaaagtagcgaagttgccgatgtcacactgccgagaaaagcttctagtgagtatttaactgcccgtaccgcaaaccgacacaggtagtcgaggagagaatcctaaggtgagcgagtgaactctcgttaaggaactcggcaaaatgaccccgtaacttcgggagaaggggtgctggtcgcaagaccagccgcagtgaaaaggcccaggcgactgtttatcaaaaacacaggtttctgcaaaatcgtaagatgaagtataggggctgacgcctgcccggtgctggaaggttaaaaggaagagttagcttcggcgaagccctgaattgaagccccagtaaacggcggccgtaactataacggtcctaaggtagcgaaattccttgtcgggtaagttccgacccgcacgaaaggcgtaacgatctgggcactgtctcaacgagagactcggtgaaattgaattgcctgtgaagatgcaggctacccgcgacaggacggaaagaccccatggagctttactgtagcttgatattgagtgtttgtactacttgtacaggtggcaacctggggacataaaaggcgttggtaattagacgaccgctgtttgattacaatttcggttggtcaaataagttgtccctatctacgcaaattgtggttcgaaatccgtgatgatattcggctcacaagccactgactttagtcagtggtggttgactcttggcctagcggggtatgattaataacgtaaatgattaagtgagcaagaagggagcgcattaaccgatgaaaagtgcaatgtttatgaaaaaggggctcgttgaagtccaagacgttgacaagccgaccgttaagaacccagacgatgtcgtgattaaggttttacgggcctgcgtttgtggttccgacctctgggcttaccggggcttagatgacaagccggccaactcaatcaacagtggtcacgaagccattgggatcgtggaagaagtcggcgcagacatcaccacggttaagccgggcaactttgtgatcgctccgttcacgcacggctgtggccactgtccagcctgcttagctggttttgacggggtttgccaagaccacagtgataatttctccaacgggacccaggctgaatactacctggcccaacacgcacagtggagcttggtgaaggtaccaggtaagccggaagactacagcgaagccatgctcaagtccttcttgaccctggctgacgtaatggctactggttaccacgccgcacgcgttgccgacgttaagccgggcgacacggtggtggtaatgggtgacggggccgttggtttgagcgccatcatcgccgcaaagctgcgcggcgccaagcggatcatctcaacttctcgtcacgatgaccgccgcgagttagccgctgagtttggtgctaccgacaacgtggccgaacgtggcgacgaagcggtggaaaagatcctcgccatgactaacggcggggccgacgccgtcctcgaatgcgtggggaccgctcaatcgaccgacaccgccatgaaggtgggtcgtccgggcgccatcgttggccgggttggtttgccacacgacgctaccatggacatggccacgccgttctaccgcaacaccgccgttgctgggggcccagcctccgttaccacctacgacaaggacctgctcttaaaggccgtcttggacggtaagatcaacccggtgaaggtcttcactaagaccttcaccctggatgaaatcaacgacgcctaccaagccatggctgatcgtcaggtcatcaagagctacgtgaaggttagcgattagaagtgagtggtcaaaaacctcctcggcggaccgtatggctaaggggccgggtgtaggatagtgcgctagcggtgttctacgttcgttcttaggcactaggcttacggtttttgagcacgttagctgaataatcgttgagaaacataaaaaaccgtcgccccatgtggggcggcggttttttgtgtgctgattggttgatcgcgttgcttacagttgttgtgctaccgcttggttaacggcgtcggcctggctttcaatcagggcgaccttgctggcaatcacttctttatccatcgtgatttcccgggtcaagcccgccacattttccttgggttcaaagaaggcgttgaactcatcagaccgttgccgggtgtggaagacggcggcggtaacggtaatgaaggtggcaaattccatgtcaccaccgaccgtcttgtctaaccaatcccactcgttgcggatccagtcccaagccagctgttggccggttgggttggccaagacgccgtggtaccagccgcggaggtcctgcggcttgatggtagtggcgtcttcgaagtggtcaactaggttacggagttgggcggtttccttggtggcgaccaaggcgccgcgcagatcttgcttgtagcttgggtcgctggtcgtccggtagtcagtcagcagttggtcaaagagggctgatgtgttgaagttttggacttcgttttttaagactaatggccggatggtggcttcgatactcagtggttggttttggtgatccaagaagatttggtgggcggcttccttggcctgggcgttgtcagcgtacaaggcggcgcttaagaccaacggccgggtcagttggtcgtcgatggcttcgccagccttggccgaccaggtgaggcggctagcttggttcacacttaattgatcgaagaagtgcttcaggttagcttcttgatcgctgcccggagtggtgaagttcttcaagaagttggcgatctggtagagggcggtgttgacgattgaggatgggtcgtccttgaacttggtcaacagcgggaccaaggtggcgtaggaaagccgcttcccttcggctaagaggcgcaggtcctggagtagttggcgcttggtgattgcatccagttggccctcttcttttaagatgtcttctaagagggtggcgtcgtagttgacgatgaagtgggagttgttaccgacgttgatccgcagcggttcaccggcttgagcgcgtaattcccggtagtcacctaggtctaagcgggcgtccttcataatttgcggggcggcgaagttagcgttcaacggaatttcccaggtccgcccctgctccttagcggcgccaataaagaattgttcctggcttaagatcaggtgaccgttttcgaccgtggccgctacgaccgggtaacccggttgttccagccaggagttcatgatctcgccgatgttgatgccggccgcgtcgccgagggcttgccataagtcggccccggtggcgttgccgtattggtgggcggcaaagtagttctttaacccttcgcgtagcttgtcgtcaccgagcagggcgcggaccatcaccagcatccgcgaacccttggcgtaaacgatcgccccgtcaaagagggcgtcgatttcggccgggtcattaacggccacgtgcaccgattgcaccccgtcggtggcgtcgcgttgcagagccatcggggcttcggtcgtttggaagagttcccagatgtgccagtcgggttctagggcatctacggacaggtattccatcatgttggcaaaggattcgttgagccacaggtcatcccaccacttcatcgtgaccaggtcaccgaaccactggtgggccaactcgtgggtgataacagtagccacgacccgcttcatgtccaaggcggtgttgtccgggtcaactaaaaggtaggcctcccggtaggtgactaagccccagttttccatcgccccggccgagaagtccggtagggccagttgccaggagtgggggagcgggtacttggtttggtagaagtcctcgtaaaactcgatcgcccgcttggcaatgtctaaggcgaaatcgagttcctttgcttggtgggccttggtggcaaagacgccgaccttgacccccgacgtagtctcggtgacctttttttgtaggtcaccaaaggcaaaggcgaccaggtaagtggacatcttaacggtctcttcaaagtagtggtagccgtcttcgacccgttcttccggcatgttggcgagcaccgtttcgccaggttgctcgtcgaacttaatcgccaggctaaaggttgccttggcttccggctcgtcgatgctagggaaggcctggcgggcgaaggtggtttcaaactgggtgccgatcagttccctttgctgcccgtcgacctggtaataagacgggtagatccccatcattgtgtcggtcaaaggggcggtgtaatcgaccgtgatggccaccggaccggttttgggcagagtgaaggtcagggcctcttgttcatcactggtttcaaatgaaagggtgcgcccttctgtcgtcacactagtcacctgcaagaacttctggtgcaaggagatggtcttggttaaggcctcaccgtcaatggtaacgtgaccggcaaactgctttgcttgacggttaatgtcgagcttgatgtcgtagtgcgttgggtgaaaggcttcataaaaacgggtaactgccatgttaacttacttccttttttgttgataggctaagtatacgcccgttgacgggttcgggggtagtaaagagacgacgaaggggtgggagaccgcattcgtcttccaccccttgtttaaattttaaccaccaagtcgacgaacgcttagttgagccggagcgggtgccagaagaactgaccgatgatcggctggggatggtctttaccaccaccgatttaaccggcccagactagattagccaaccactcggggtggagcacctctttgtcaacttggaccgcttcttgccccaggctaaccaaacggcggtcagtttaaggacctggcgggattgtcctttgtcgtccttgatgacatcggggcgtggaaggacgtaattggcaaagaaattgaagatgcccacttcatgtgccaagacgaacgcgacgccatggacgaaatcacgcgctactccagctttccgtactttaccaccaacgtaacggcggccgacccgtcctatcacccggtgccagccaacaaccgggtggaacgatcaattaaggggcccaaagcggagctgacgatttacgtgaccgtcaagcggcaacgccaaacccaggtgcaaccgttagtggaccgcttgaaagcggcctgggcaaagctaccgaccacccccaccaccgggggaacaaatgtgctaaaatagagtaattaagcgattgagaaggggtcaaaatgggaactgtaattattttaccggagctggggcaggccacggcggcctggcaggacttagtggtgggccaccgccaaaagcaggtggttgattacgaaccgctcttagaaggggcgccggaatttgaagaactaagtgcccaaataacggcgctggtgcgcgcggccgaacagccggtcaccttggtgggcaacggctttggggcattggtgggtctgcgggtagccgctagccaatcggggcgcattgaccgcctcttgttggtggcccccaactaccacttaacggccgacctgaccgtcagggcgctgccatcgttatttacccccaaaccggtcaaacagctcctacgctccttaaacgggaccaccctggccaagtggttaaccaccgtccagtgccgggtgagcgtgatcgccagcgaccgcgaccgggtggccagggacctcgacttacggttagtcgacagccactttgttcccgttagcttgcgcaaggggctcagtgaagagaccctggcggcgattgaagatgagttggcctaggaagcgcttgccaggcggggaaaattccgtcataatgaacaaaaagtaagcatgaggaggaattgccatgctacacaatcccgttgttgatcaaattaccaaccaccgttcgatccgtaagtttaaggatcaaacgttgaccgcagagcagctacaaaccctgtacgccgccgctagtcaaacctcgacgtcgatgtttatgcaacagttttcgatcctgcacgtgaccgacgaaaagttgcgtgagggtgttcggaacatctccggccagccgtacattggtgctaacggggatctgttcgtctttgtcgttgacctttaccgtaaccaacagatccgccagcagctgggtaaggacgatggccgcctgcacacgaccgacatcttcttccaagccgttgaagacacggtgttagccctgcaaaacttcctgaccgccgccgaaagcctggggctggggggcgtcgtgctcggttcaatcaaagatgacccggccgaactggtcaaggtcttgaacatgcccaagatgaccctgccgttgttggggttgcaagtgggggttcccgaccaagaaccgcaattaaagccgcgtttgccacaaaaccaaattgcctttgaaaatcactacccaaccgactttaaggtgggggatctaaaggactacgacgaagtggtcacgacttactacgacttgcgtgatgccaaccggcggatcgattcctttaccaagcaaatttccggagccaagctggccgttcacgacacgaccagggataagctagccgccaccatccaagcccagggaatggcactcgactggggcaaaaactagccggcgccccgactttttggtattctaaaggagccaccgtagcttaataggtagagcgtcattcatggtaaggatgaaggagctggttcaaccccagcgggtggcttagggaaagtgcgactaaccttttcgacgggccgttggactaagctaggacgggggttggggcggaacgcaccgttctccggccgtacttaggcactaggcccgtggttgggagcacgttattagaagtgcgaatcaaccattgggcaggacgtttgagttgttacagaatgtagccgggagaaggtaacggttctcctggcttttttattacaaaaagtaagaaacaatgttgacaattgggaggggttctcctaaaataatgagcaatgaatgagaaaatgctgtgaatggatgagtagtttttcaggatgtcaagaagcgagccggaggtggtgaaagccggtgacagtacaaaagatgaagatggtccaggagtgttttgatcggtgagcccatggtaaattgatcacggttaacgtccgctattgcgttgcgcccccccggttggggtggcgcttgagggtcccaatggggctgaaaacgggtggtaacacggctcaagtagtgcgtcccagaaaaggcaggtgccttttccgggatttttttgttttaaggaggagaaaagaggatgcgcaagtaccggtggtggctagtagccatcttgattattattttagcggcatttggtttacacttggccactagtagtaaggtcagtcaacacaccgtaacggtcggggcgattggaccggacgttcagctctggcaacacatcgcaaagtctaaggcggctaagaaagcgggtattaagattaacgttaaatcctttaccgatccgattggccttaataaggcaacggctagtggtgaaattgacgtaaatgcctttcagtcttggtcgtacttagagacatacaacaagcaaaataaaaaggctcagttagctgcattggggacgacctacttagaaccaatgggaatttattcgaaacgatacaagaaggttagcgatttaccaaacggggcaacaattgcgatcgccaataatccggctaacaccgctcgtggattgctcttgttacaaagtgctgggttgatcaccttaaaaaagggctttggcgccacgtctggaactaacgagattgcatctaatccacgccatttcaagttcaaagagattgatgatacgactggaccacgggtcttaaactctgtcgatgccgtattgatcggaaatacgatcgccttgaccggtcacttgaacgtcttaaccgattcgatttaccacgaaaaaatcgatcaaacgacgaagaataacattaatattttagcaaccgccaagaagaacgctcacaaccagacctacctgaaattagttaagctttaccacaatcagcaaattcaggaatggatcaaaaagaagtaccaaggaactaaggtggaagttaataaacccctctcgtaccttgaaaagtagtaaccctacttttcaaccaagtttggtgacccaaacaagattatctggtatgatgaattatgcaacaaaaaaaggcgccccttcgcgtcttttttgattaaggaaattttgggtacggtggagtctgtcagaaaggttttgtatgtcttttatcataacgctcacgggaattttattcgttacgcaactggtttcccacttctttaaccgctggggaatcccagacgtgatcggccaaattttagtcgggatcgtggcggggccggccgttttgggttggattcaccagaccgcaatgattgaggagttccaagagatcggcgtgatcgttctaatgtttatcgccgggttggaaagcgacctgtcactgctgaaaaaatacctcaaaccggcgatggccgtcgcggtgggggggatggccctgccgatcgtagtcatgggcctagcctcgcaattgtttggcctccagtggtttgagtcactctttatcggggtgattttctcggccacctcggtttcgatttcggtggccgtcttgcgcgagtttaaccagatcgacagcaaggagggggcgacggtcctcggagcggccgtggccgatgacatcggtggggttttgatcctgagtgtcttaatctctttgatgaacggtaagggtggtgaatcgtcaaccagcctgccgctgatcattatgatgcaagcgatcttctttggcgggacctacctgctggtccgctggctagccccgtacctgatgcacttgagcaagcgcctgttgacgacagcggcccccgccgtgatggcaatgatcttgtgcttggggatggcttcgttggccgacctagttcacctaagcggggcagtgggggccttttttgccgggattgccgttgctaacaccaaggcccgccacgacatcgccgaagccttcgagccgcttggctacgccgttttcatcccggttttcttcgtcaacgtggggctggtgatgcgcctgaaccacttcttggactcactggtcttcatcgtggtaatgacgattttggcctgcctgaccaagttgattggttccggtggtggggccatgctgatgggctttgatcgccagtctggttacgtgattgggagcgggatgattgcccgcggggaaatggcattgatcaccgcccagattgggtacgaggcccacctcctgtcgtctaagtactattccgacgtgatcacggtggttgtgttggcgactgtctttgcgcccttcattttaaagcacgccttaaagcggctgcaccaccccgtaacttattaaagcaaaagagcattccgacctagctggctggaaggctcttttttatctttgtggttccgtggggggggcaatggttaagtactggctggccgccccggttaaagcgggcgtgaccggtcctagcgttagcatcgtcaaggcgtgcattgctcgggtcgccatcgtgtacaagagcccggtagcttggtcgccgaggtgggcggccgagacgttagcgatcaccacgccgtcgaattcgagccccttagccaggtaaattggcaagatcaagaccccactggggagctggctgtcttcttcgctcaggcggtgcaggtcagttacttggccgtagaggtggtggtaaacctggctggcctcttcttgatccctggtcaaaacggcgacggtgggaaatcgttgctgcatggcttggaccgccttgattaagccggtttgccaggccgcttgcccgtaatgaacctgaagcttggccgggtccccgtggcgggcgaaggcggtgatttcatcgccgtcgggcaacagggatttagcgaaggtggtgatttcaaaggtggaccggtaagagcggcgtagggcaattaagcgggggtgcttagctgctagggcgtcgccaacccggttcaagagggtttctggtaactcgagcggtttgaagagggcctgctcggcgtcgccaattacggtaaacttagcgtccggaaaggcgtgcttgaggtagatcaaggtcgccagcgagtagtcttgcatctcgtcaatgaagacgtattggaaactgcggttttgccccccaccggtcaaaaggtcgcgcaggtataagaagggagcggtgtggactagcttgatccggtgaaattcaacgccgtgactaaagtcggtggccaattgctgttgcactgcttccgtgatggggccggttaggggcaagtgaagcaggaactggcggtagagggcgtgaaagtccaaaaagtagttgttgtaaatggcgtcggcgaccacccggagccgttttttcgcccagcggcgggctaggtaggcggcttgggcctgttcatccgcaaagtcatcgatcgtcttttggccgtagagggcgtgaagctcttggttggacagggtgtcgagctctttggccacccagtcgcgcttggcttcggtggtagctaggtgctgaaggcggcggagcagggcgtttttgaccttaactagccggtcggccaccgtcattttagcgacctggtggtgatagatgctggcgatcgcttctttggtaaacagggtgcgcccttcaaaggtcaggtcggcgaactgaaggggggcttggctgttggccagttggtcgacgtagtccttgacggcggccatgctagcggcgccctccaaccaatccgctaccgggtggggggcattggattgctggcgggtttcatagcggtcaaagagtgattcaacttgtagcccttcaaagcggcgggctaagaagttaggtagggttacctggcgcatgttacgttcaccaagcgagggtaggaccgaagcgatgtagtgggagaacaagaggttgggtgagaagaggacgatttggtcggcgttcagcgattcacgggcgtggtagagcaggtaagcaatccgctggaggatcgccgaggtcttcccggagccggccaccccttggaccaccatcaaatcggcggtggtgtttcgaatgatgtcgttttgttccttttggatcgtggcgacgatgttttgcatcgtctgatcgttttgccgccccagggccgcttgcagcatggcgtcgccgaccgtttcattggtatcaaacatgttttcaatctggccgtcatggatggtgaactggcgctttttaaccagggtcgtccgttgggtaccggccggggtttggtaagttaccgggcccagggtgccgttgtaatacaccccggcaatcggggcgcgccaatcgtaaatcaaaaagtcggtccggtcctcattcattaaagaggccgtgccaatgtacagggactcggcttctgcttgccccgggtcttgaatgtcgatgcggccaaagtagggttgggcccgcaactgttttagggtgtccagttggtgagccaggatggtttcgttttcgctggcccgggccaccagttggcgctgttgttcgatttcggaccgtgattcggcaatgtcgtcgatttcgtagcggttaattgaggcgttttcgctgtagttttgctccaccgcccgggtttcttggtgggcggccgctagtgcttgtttggccccttcaatttggcggtcgatttccttgattaccgtatccacccgcgcttgttctcgttgttgttccgttagttcagtcaccaaatgaccccccaaataaaaaattgtcaatccattgtagcactcggtacccatcaattaacagaaatctgctagttaactttggccgggtgagaatttaatttgtgggggattatccgtgttgcccccggttgaaaaatggtaacataagagggataaacattacgaaaaaaacaaaaattgaaaaggggggtgatgagtcgtggaaaacctggcgattgttgacctgggctctaattccgtccgcatggcaatcacggaaattgccgacaacggggactttcgggagatcaagcgggtcaaggaaaacacccgcttgtccgagggaatgggaacggagaagatcctccaaccgcaagcaattgaacacacgattgcggccttaaaacggttcaagcgactttatcagggtttgcccaacctgcaggtgcgggcgatcaccacggcggccgtccgccaagcaaaaaaccgccgcgagtttttggaccgggtcaaaaaagagaccggcctgggatttcaggtgctgtccgggcgcaaggaggcctactacgactacctaggggtggtgcgcactttaaaactgagccactgcctgattttagacgtgggcggtgctagcagcgagttgatcctcgttcaacacaagaaggcccgcgacctaatctcgctgccgtttggggcggttaacctgtcggaacagtaccacctgggcggcttcgtacgggccgacgacctcttccgtgcccagtcaatggtcatggagcgcttcaacaagatcccgtggttgcgctacgccacccgggtaccgatcgtcttgttgggcggggccaaccggaccctagcccggatgacctacgcccaccggcgccagcacgggaattcctttcacggctaccggctgtcgtccaaggtggtgtacggcacctaccgggagctattgaaccgtaacctagcccaacgcaagaagatgccgggactagaggccgaccgcgccgacatcatcattggggggatgttacccctggtgtgcttgttgcaacgtaatagcgacgggcgggtaattttctcggaatccggcgtgcgggaagggatcattaccgagtacattcaaaaacggcagaagggggagcaaaatggctaaggactggacccacggtttttacaagcggagtgcgcaggaacggcgtagcttggttaaacaagcgagcgcccttagtgatcagcaagcccaaaccctagccaaccaagccacccagctcggcgatcaactggtggaaaactacctaaccgactaccacctgcccgagggcctcttggtcgggttagtggtcaacggccaagactacatcctgccaatggtcaccgaggagccatcggtgattgccgccgctagcaacggtagccagcgggttgccaagagcggcggctttgtagccacggcagggccccgggcgctggtggggcaagtcgtcttgtgtgacgtggtagactttggcgccaccaaggactggctgctggaccaccaggaaccaatcctggcggtggccaatgacgcccacccgtcgatgcaaaaacggggcgccggagccaaagggatccgggtacggattgaaccaccctttgttagcctcgacctcttggtcgacgtctccgaggcgatgggggccaattcggtcaacacgatggccgaagcggttggcgcctggctaaaggagcagggctaccaggtcctcaccgccatcttaagcaacctagccaccgacagcttacagacggtgacctgtcaaatcgatccggcccacctggccacgagcgaaatggacggggtgacggtggccaagcggattgccttgatgagtgacctggcccaggtggacgtttaccgggccaccacccacaacaaggggatcatgaacgggatcgacgccctggtcctcgctagcggtaacgactggcgggcaatcgaagccggcgcccatgcttacgctgccaaagacggccactaccgggggctggcgacctggcaatttaaggacggccgcctggtcggggagctaaccctgccaatgccgatcggcgtggttggcggttcgatcaagctgactccccaatcccaggtcaattaccaaatatcgcaaattaagagtgccaaggaactggcgggtgtaatcgtcgccgggggcttggcccaaaacttagcggccttgcgagccctggctaccgccgggatccaagcggggcacatgaaactccagtaccgctccctagcacttagcgtgggagcgacaaccgccgaggcgcccgtcctcgctaagcagttagcggcggcgggacacgctgatcggcaggtagctagcgaactgctggcccaactcagaaaggaagcacacgatggcagaagagaagattgaactatcagcaccagttaaggaattgttggacgaagtcgatgccttgtaccccttagggatggtccacgttgacttcactggtgacaagagtggctttgttcgccacgaccaggccaacctaaagcaggtaccggggatgatggtggtccaagtcagcgacctgacggagcccaactacacggcttcccacgagctcttgcacctttactacaccctcaagcaatacccgcaggtgctcttcaacctaacttggggtgacgaggatttagacgatcagtcgcggatgtttgccaccggcctgtacgacgcggtgatgcaccgcttgatcgtggccgaacaacgcaagcgcggcctgattaacgaccaaattgaacaagagtacttaatggggttaaaggacgccctgccaaaggaggacgccgacccgctagctagtgcggaccagaagatgaacaccctggtgcgggtgattaacctctttgacgccctgaccttttacggcgagcacctggctgcgattgaaaaagagttggtcgccaactacccctacgccctttccgtggcgaaggagtggcaagctaagctcttcaaccggccaatggaaacgccgtgggaaacccggcgcacgatcgttaacctctttaagctggttgacgaacagatgcgtagttgggggttgccggtcttaaacaaccagcgttacacgaccgtgaccccggtcttgtccgagcgtcaattacggctggaagttaagcaggtctttgaaatttaccgctccgacatgcagttaaagggtaaccagggggatgcctacgccggcttacggcgcggcgacgggcaaaactcctttgtcatcccgatgccggagaaaaacagcccggctgaattcgtcaagctctacgctgaacccgtacaagaatttttggagaaacgcggctttccgtacaccgttcgggagggataaccatgctagaacaacaagccttgtttgatcaggcccaccagatcgtctttttgaccggggcgggggtttcgactgcctcggggattcccgactttcgctcggccaacgggctgtacaaacaaaaccaaaacgcagagtacttcttgagccaccgctattttcaaagcgatccggaagggttttaccagttttgcaaggataacctttacttcccagacgccaagccgaacgtgattcacgaaaagcaggctgcctacaccaagctcgataaggcaacggtgatcacccaaaacatcgataacctgtacgagctggccaggaccaagcacttagtcgactttcacggcaacctctttgacgtctactgcgaaaaatgtggcgcccacgtgccagttgaagagtacctaactagtcgcctgcacaagcttgaccaagggccgctgcgccccaacatcgtcttgtacgacgagggaatttctcaggtggcgataaaccagtccttggccgccatgcaagcggccgacctgattgtggtggtggggacctcgatgaaggtttacccctttgctagcttgttggaatacgccaagccgggggttaagatcctggctgttaaccaggagccgctggagttgccgggcaactttgaaatggtggtggctgacgccacggacttctttgggcagctggaggttcggtaaagagtaagtgcgacccaatctatcaaacaggccgtatgactaagctagggcaaaggttggtgccttggcgccgttctttgcctgtacttaggcactaggcgggttgtcgacgacgctttttatgtaacacttaaaaatccaaaagaggctaggaaattttcccagccccttttttgaaagcgggcaaggaaacacattcttttaaggacgtgatgaattgccttttttgtgcccttagggcacatgatcgaaccgtaatgtaatataattattggtatgaaagatacaaaaagaattacatatggtagaacgtcagtctacaatcttaattatcatttaatttggggaactaaatatcgtaataaagtgttgaaagaacggtcaagtccaaaatgttggtgtaaattaaattccgcgaatttatcatttcacaagcttaagcataccggcttcttctgaattgtcatctttttcaatcccgtggtaaacggtcatgtttaagtaccgtggaccagcagcccatttttcattctgttcaatcagtagtgctcccattagtcgcaagacgcttagatcattcgggaatatccggattacacggtcacgacgacggatttcttgattaacccgctcaattgtattattcgtccggagacgcttccttagctcctctggaagctggtaaatcaccattaattcgtcaaaactattttctaatttcttcaccaccttagggaactcggtctgccaatctttaaccaattggtcacgccgttcaaccgcttggtcgtacgttggagcattaaataaatctttgagtcggttagcaacttctttacgatccttgagtgccagaatacttgtacagtcattactaaaatgaaattgacatctctgccaaaggctaccctgaaattgcgtagtgattgcatcctttaagccacaatgagcgtctgaaacaaacatatcaacgttggtaaggccccgctgtttaagttcactaaagaagtccatccatgcagcttttgattcactatcaccgatatcaaaaccgagcacttctcgacgaccgctagggtcgattccaatcgcaacgagtaagctattacttgtcacaacgtgaccacggtgtaccttaaataaaattgcatcggcatacacaaaagcatacttttgcgtaaggggacgtcggttaaaattcagcacttggtcgtccaaattattgcataaagccgagaccgtacttttagaaaaggttgtcccacataacttcttagtaatctcagctactttacgtgttgaaacaccttggattaccatttccattaatgccaaatcaaaggcctgctcactacgctggtagcgtttgaacagctgtgttgaaaaattgccatgacggagtttaggaacgtgtagttctagagaccctacgcgggtggtaagctgacgaacccgataaccattccgtgaattggttcgttcatccgaacgttcataagccttagctttaatctgctcagtcgcttcggacttaagaatttcgtcaaggatcttggccataattgattgcatggccttatcccgatcacctagtaatagctcctttaattcgtcatcctctaaatttaattcaacttttggcataatgaagttcctttcagatttcacaaagtcttatttagaatttacaccaattatacggacataaccgaaagaacacgtagaagaagtcttgaagcaatcattatatgatatagcttcaaaatatggatttacgattgctcatatggagattggtaaagatgaccatatccacttactagttagcgctccgccaaaactgtctgtaactaacatcatgcgctggcttaaaggcatttctgcatggcacctcttccgagaatgtccagaactacaaactagctactggaaaagcaaggtcgtcacctatggtcaccaagttattatgttgaaagcattgggagcgttaatgaacaagcagtagccaagtatattgatgatcaacgcaaaaaggaggtgaaattagaatgaacaaattaattaaaggggtcaagctacgcttgtaccctaacaagcaacaacaagctcaactatggtaaatgttcggcaatgaccgtagagtgtggaatctcatgctagatatggctaagcaacgctatcaaaacaatcctagcagtcattttgtaaatgaatatggaatgaattacttgcttaaacagttgaaacaagaatatccctatctcaaagacagcgatgcgactagtttccttgtggtgaaccataatctagtccaagcttttaagatgctgtttaaacatcgtggtggctatccacgctttaaaagcaggcacgccgccaaacagtcatatactggtcggtcggtctgcacagtgattgccaagagaagaatgaagctacctaagttaggaagcattcgaactagtaagacctctcaagctgtaaatggcaaaattaagcgttataccgtcagctatggtccaactggtcgctactacttatctttgcaagtcgagactgttgctccagaagcattgccaaaaacaggcaagaccgttggcctggatgttgggatcgctgacttagcaattagttctgacggtgaaaagtttggtactttcaatgctaagtggttggaaaagcaagccacaaagtggcaaagcaagtatagtcgccgaaaatatcaagcaaccgtagctgttcgccaatggaaccataatcataaagacgtaaaaatggatctcaatgattatcagaattggcaacgggctcaaaaacaaaaggctcgctaccaacaacggatagcgaaccaacgtcaagattacttacacaaactaacaacagccttagttaaaaaatacgatgtgattgtcattgaagatttgaaagccaagaatctacaaaagaatcaccatttagctaaagctattgcgaatgccagttggtaccaatttagaaccatgctggaatacaagtgtgattggtacggtaaacagttaattactgttaatcctaattacaccagtcagatctgtagcacgtgtggttaccatagtgggaagaaaccacttgaaattagagaatggacttgtcctaaatgtggtactcatcacgatcgagatattaatgcggcagttaatatactccatagaggattaaaagcctttggctagggactagccgtggtaaaagaacggagttctgtaagttaggtattctgaatacagaagcaacatcctaaatactacttcgtgttcccagaagctcggtcatttatggccgagtagttcaccgtctaaattgagattcagaaaattaattgcggaggtttaaatgactagagtggtgaagcgcaccatcaacatcatgttggtgtgccaatttttgatttgtttggggatgagcctgattttcccggtggagccggcgatcaaacaggcttaccacctatcggcctttgacatgggggtgatggccgccctctttgccctagtccaattcgtggcctcaccggtggtcggtcgggtttcggataagtgggggcgcaagcagatgctggtttggggcttaggcatctttgccggtgccgagttcttgtttgcggcctgtaactcgctggccgcctttaatacctcacgggcgattgacgggttggcggcggcgatgtttgttccaacctcgatggccctagccgccgacatcaccaccccggcgcagcgggctaaggtgatcggctggctgtcggcctctttttccggcgggctgatcttgggccccgggattggtggaattttggccgccgacaacttcaagttacccttctgggtggccggagtgttaggggttatttcgacgatcgtggccgccatttggttgcctagcgatgaaaaggtgggggttacccaccacgaagaacaccgccaggagaagtcgacgatgacggcgttaaaggagatttggtcgccaaccgtgagcctgctcttcttgatgattttagtggccgccttcgggttggccgggtttgaggcgatttactcgctgtacgtcaaccaggtgcacggctttgacctgggccaaatcgccttggtcttgaccttaaacggaatcatttccttggtcctgcaggtcttttgctttgaagcgatggttaagtggcttggggagttgcgcttggttcgctgggcctacttgctagcggcggtcgggacggtctttgtcatttacgacggcatcgcttggcaaattaccttagcgaccctggtcgtctttgaagcctttgacctcttacgcccggcgattaccaccctgttgaccgacctgggggaagacaaccagggcttgattaacgggatgaacatgtccttaactagcgtcggtaacgtgattgggccgctaatggccggggccttgttggatcgcaactacctgtacccttactgggtggtaattgcctttctgttagtggcctgggtgttgaccttcgccgtccggcgccgctttagggcctaggcgcttgcaaacgaagctggattggcgcaagatacactaaaaggaggggattgaaatgaaggtcaccgttggcttgacgacctggagcgaacaccccagtttgattaacaacgcccgcaagaaaacgaccttaaaggagtacggccaacactttccggtggtcgaggttgataccttcttttacgccctgccccagctcacgacggtgcaaaagtggctaaccgacgtggccccgggctttcagtttatcgttaaggcccaccaggtgatgaccggacaccaggaagccgttggcggcccccaggccgtcttcacccagttcaaacaggtcgtggcgccgttagttagcaccggtcagcttaaaacggtcctcttccagtttccaccctactttgacgcccggaccgaacacatcgagtacctacgcacggtgcgggaactgatggggaacctgccggtcgccgtcgagttgcgtaaccgttcctggtaccaatcgggagtgggcgatgcactggtcaattattgccgtgacctaaagctgaccctggtggccgccgatgaaccccaccaaacccagggcggaattccctttttcttgactactacgacgccgcacctaaccctgatccgcctgcacgggcgcaaccaagccggctggcaggccgggggcaaggactggcggggcaagcggaccctgtaccgatactcgacgagcgaactaaccgacctggcccaagcaattcaagaacaacagccgcaaccaaaagaaacttgcgtcatctttaacaacaactcggggggcgatgcggccgacaacgccgtcgccctcagccggcaaatggatttacactttacgggcctgaccaaacaggccccgacccaactagaactcttttgaagtcacgtggttttgcgccagtttggttcgaaatcggcgtggctttttgctatactggaagttaacgaaaaaacgattatcggaaaagaggtcccgctgtatggctgaacaaccaacctactacatcacaacaccaatctattacccatccggacgacttcacatcggtaactcctacacgacggttgcctgtgacgccgaggcccgcttcaagcggctcagtggttttgacgtgttctttttaaccgggacggacgaacacgggctaaagattgaacaaaaggccgaaaaattaggtaaggatccgcaaacctacgtcgatgaaatggcggctggtatcaaggaactgtggcaaaaactggaaatcaccaacgacaagtttatccgcaccaccgatggctaccacgaagccgccgttcaaaagatcttccaacaactcctcgaccaaggagatatctacaagggcgaatacgtgggctggtactcggtcgatgacgaagagtacttcaccgaaagccaactcaaggaagtcttcaaggacgaaaacggccaggtaaccggtgggattgccccgtctggccacgaagttcaactggtgaaagaagagtcctacttctttaagatgagcaagtacgccgattggctgatggactactataaggcccaccccgacttcatccagccagaatcgcggatgaacgaaatggttaagaacttcttggaaccaggcttagaggacctggccgtaacccggacctcctttaactggggggtcaaggtgccaaacgacccgaagcacgtggtctacgtgtggatcgacgccttatccaactatattaccgccctgggctacggcagcgacgacgacagcctctttaagaagtactggccagccgacgttcacatggttggtaaagaaattgtccggttccacaccatttactggccaatcatactccacgccctgggcttgccactgcctaagcacgtcatcggccacggctggttgacgatgaaggacggcaagatgtccaagtccaaggggaacgtggtttacccagaaaccctgattgaccgttacggcttagacgccacccgttactacctgttacgggcgatgccgtttggaaatgacggggtcttctcaccggaagacttcgtcgaaaaggttaactacgacctggctaacgacctggggaacctcttgaaccggaccgtggcgatggtcaacaagtaccaagccggcaagttggtgggtcaaccaggggccacgaccgactttgatgctgacttagagcaagtggcccaagacgccctggtggaataccgggaattgatggatcagacccgctttgccgacgccctgtccgccatctggaagttgatcgcccgggccaacaagtacattgacgaaaccgaaccgtgggtcttggccaaggatgaacaacaagcacccgtcttaagcgatgttttgacccacctggccaagtcattgcggatggtagcggccatgctgcaaccaatcatgccaacggcacccaaggaaatcctgggccaactgggcctagccaaggaagccatttccctctctgacctctcctttaacgacttcccggccgaagtagtggtggttgaaaagggaacgccgatcttcccacggcgcgacatccaagaagaagtcgacttcattaagtcccaaatgagcgccaacgaaaagcaaaaggggcgcaaggccatggaagcggccaagactgctagcgttgacccagtcaaagccgaaatccagtttgacgactttgacaaggtggacctgcgggtcggcttgattaaggaagccggcaaggtgaagggcgctgataagttgctgaagttcaccctcgacgacggcatgggcgggcgccaaatcctgtccgggatcgctaagtggtacccagtaccggaagaactggtgggtaagaaggtcgtcttcgtggccaacctggctccccgcaagctccgtggtgaaattagccagggaatgctcttatcctctgaattaaacggccaggtacaactagtgttagttccagacagcctggaagttggctcaacggtctgctaagcaatgacgattaagatttacgattcgcacacccacttaaacgatgaggccttttacggtgacgtaggggcctttttggcccgggctaaacattacggggttaccgagctgaacatgattggctccaaccggctgttaaacgaccgcgcccttaaactagctagcacctacccgggcttgcacgccgtaattggctttcaccccgaggacctagcggaagtaaccccgaccgattgggaggggctaaaaaaggcgttgcgacgtcccgaggttgtgggggtgggcgaagtcggcttagactttgtcaacggaatcgccgaccaccgggcccaagaagccgccctagttgaacaaattgacctggctaaccagctaagcttaccggtggtgatccactgccgcgaggccctggccgaaacataccgggtcctagtggagcacccggttaaagcggggggcgtgatgcactcctttagcggtgacgcagcgtgggcggaaaagttccttgacctggactttgacctctcctacagcggggtggtctcctttaccaaggcaacggaagttcacgaagccgccaaggtaacccctttggagcggatgatggtagaaacggacgcaccctacctgaccccggttccgtaccgggggaagcaaaacgagcccgccttcacctactttgtggtcgaagcgctggccaaactcttgcaacgctccgtagaagaggtggcctcagcgacgttgcagaccgcgacaaaccggtttttgaaaggacataatggacaagattaaagaagtaattgtggtggagggtaaagacgacaccaagcaggtgcaacgagccgtgttggccgacacctttgaaacgaacggctccgccctgtcaaaaaaggcgcttgaacaaataaaaaaactccagcaaagccggggggtgatcgtcttcaccgatcccgattttaacggcgaacggctccgtaagctgatcgaccaaaacgttcccggcgtcaaacacgccttcatccggcgcgaccagggggtgccaaccgaggcccacgggagcctgggggttgaacacgcaagctcggcgaccatcttggcggccctgcaaaacgtctacaccaccactcccgttttaacccccacctttagcaaccaggacctcatcaaggcgggcttggcggggagcccggtagctaagaggcgccgggagcgcctaggtgaattgctggggattggctatggcaacgctaagcaactattgaagcgtctcgacctctttgccattgaccggccgacctttgaacgggcggttgcacaacttgatcaggaagggaaaacgcatgagtaagcaaattgggagtccctcgcggacccgcgccattatgaaccagtacggtatccacgctaagaagggctttggccagaactttttgaccaaccccgacgtcttgagtggaatcgtgcgggcggctggtattaccaaagacgataacgtaatcgagatcgggcccggaatcggggccctgaccgaaaagctggcccaagcggccggcgaagtggttgccttagaaatcgacgaaagcctcctgccggtgttagacgacgtgttagccccctacggcaacgtaacggttttaaaccaagacgttttgaaggccaacctagccgacctggttcagacggcctttaaggacccgaccaagccagtcaaggtggtcgctaacctaccgtattacatcaccagcccgattctgtttgccctcttagccagccaagtggagtgggcggcggtttgcgtgatgatgcaaaaagaggtcgccgatcgcctggtggccaagccgggaactaaggactacggcgccctgaccttggcgatcgactaccggatggacgtcaaagtcgcctttaacgtctcacgcaagtcctttgtaccagcccccaacgttgactcggcgattgtcgttttgacgcaaaagagtgcggccctgccggtgtccccctttaacgaggaccgcctctttggcctgattcggggctgctttgcccaccgccgcaagagcttgtggaacaaccttaagacgatcgtcggcaaggacgaggaccgcctagggaaggtaaaagaagtcctggaccggttggaaatcgattcccaaacccggccggaacgcttgagcctggtggacttcatcaacttagcgaacgccatgcacgaaaaggaattgctataaaagtggggaagagtttccctgacaattgcaagcatcgcgaacttaggtggtagcttgctatctaatgttcgaatgtatagtaagaggccggagaaaacacgttttccccggcctctttttgccgtcactaaccgcggggatgacggatgacagagtaccgcaagcggcgcttacccttgccccgagcgaatgacttggcggctttcctcataccttttgcgtcaattagcgagaattagtataattaagggcaaactgagtcgaaagggggactgtggaatgatcgtgacggaaaaggcaccggccaagattaacttggccctcgatacgcccatgcgctaccttgacggcctgccccgctggaacatggtgatgaacgccgttgacctggctgattacgtcaccgtggagattcaccaccgaccacagacgatcaaggtttacaccaacagcggttttttacccaatgaccaacgcaacctagcctaccaagccgcccacatcctaaagacccgctttcaccagactgatggggttaccatccgaatcaaaaagaagattccggtggcggccggcctcggtggcgggtcttcggacgcggcggccgtcttgcgggccctcaataaggcctggcgccttggtttatcgttagacgagttggcgcgcttatccttatcaatcgattccgacgtgccattttgcgtgtactcccaaacggcccacgtgaccggccacggggagatcgtggaacccctgccggcctttccccactactgggtggtgattgccaaacccaagctatcagtctcgaccccggttatcttacgccagattaattacgagcgtttggtccacccgcaaacggaccagctggtggaagccatcaaggaaggaaagtttcaggagagctttcagtacatgggtaacgccctagaggcggtgaccatggaggcccaccccgaaatcgcccgtttttaaaggaacggatgcaaaaattaggggccgacgtggcacagatgagcgggactggtcccagtgtcttcgccttgtgccacgccgaatcacgggccaagcgcatttataacagcctgcgtggcttttgcccggaggtctaccaagtcgtcttgttataactgaactgccaaaccctgggcgctacgtgaaaaactgcccggggtttccacgtgttaggcaaagagtttaacttttttaaaaaagggcttgccattttgacccagaccagttattattcttcagtcttaatcgtaaggattacgatttaatgggaaataagactggaggattttgtgatgaagcgaaaatactggggaattggggcgcttgtggtcgtcctcgccgtaatcgtgggcttaatggtgacggggtggagcccgtctaagtcccaccaaaagccaatccgcgtggtgacgagcctgaacttctacggagaagtggccaaggccgtggctggggatcacgggacggtgacctcctttattaacagttcggccgttgaactccacgagttccaaccaacgaccaagcaggccaagcaggttgccatcgctaacgtggcgattgaaaacgggctgggttacgacgcttggatgagtaagatggtcaaggccgacagcaagaacaagatcaccctgattaacgtcggtgaacaagtcgccaaggaaaaagacggcgctaacgaacacgtttggtaccgcccggcaacgatgagcgctttggccaccaccttagccaagcaatttagcaagctggatcccgaccacaaggccgactacgaaaaaaacgccaaggcttaccaagccaaattacaaaagctcgacaaggtaattgcacaagccaagcaaaacgtgggcgataaccgcttagtggacgttagcgaaccggtcttcgattacgccttggaaaacttgggttaccaaatcaatgaccaacactttgaaaaggccgttgaagatgacagtgatccgtcaccaaaggacatccaacaaatccaagatgacattaccaaccaccggatcgccttctttgttaacaacagccaagaaagcggcaaaacggtggaaaacctggttaagttagccaaggaaaacaacgttccggtcttaaatgtaactgaatccgaaccagacggggaggactacgtttcttggatgaccaagcaataccaagccttgcttaaaatccaacgaggtgaataattatcccaattgtaaacgtcgaaaacttaacactagcttacggcgataaagaagttattacgggcctgaattttcaggttaacccgggtgactttttagtcgttgtgggggaaaacggggtcgggaagacgacgatggtccgctccttgttagggcaattaaagccccgccagggccagatcaagctggcttcagacatcaagatcggctacgtcccccagttccggaacttggatagcgaataccccctgtcggttcgcaattttgtggccctaaacttaccgaccaaccggataccgtggttgaaccgaacggagcggcaaagggttaagcaaattgtggccgcgaccgacctgacccggattgccgaccggccactcggtatggcttcggggggcgaaaagcaacgggcctacttggctcaggccctgttagccgacccgcaactcttgattttagatgaatcaacggccagcctcgataacgaaatgaagtacgacttgcttgacctggtggaagacttccgggccaagggaggggccgtcctctttgtcacccatgattgggaccttgctcgccactatgggacccgttacttacacctagaagcggggcaggcgacgagcggaccaatcagcgaactaccgatgggcgaggaggaagaataatgtttgaactgtcatttatgcgttacgcctttattgcttcgaccttcattgcgatcgtatcgggagtgatcggggtctttgtggtcgcccggcggatgtcgtttttgacccacaccctgtctgaaattggctttgccggggcctcgtttgccgtttttgccggctggcaggccctaaacgggatgctcttgtttaccatgctgtcgtcggtaatggtcgggcagatgagcattaaagaatcccggcgcgaagctgtgatttcggcggtttcggccttgtttatcgggttggggatcctctttttatccctgtctaaccaaacggctagctcggcgacgagcatcctctttggttcggtggtggggatttccaagcgggaagtgtggcagctggtcttattgtcgctgttagtcctggcggtggtctttctcatgtaccggcgcctcaagtttgattcctttgatccggtgggggcccgggttaacggggtcaacggaacgctcgtgtcggtaacctttttaatcctggtcgccctgtccgtttctgtggcggcccagatcgtgggctccctgctaatctttatcctcttaaccctcccggcggccgcggctaagtactacgctaccgggaccgccaagatgatcggcttagcgattttatttgccctgttggggacctggttgggcctttacctgggctacgtcactaactggccgatctcgtttttcattgccgtgattgaagtcgtaatctacgtcagcgccctttactatcaccaccgggtggttgcttaagtgaccacgggtgctttctaatatcagtaacttaaaaaaagccattccgaaccatgttcggaatggctttttttatttttcggataaatcgtttaacgttgggtaatttttgataataattagtcaaaagacgaacaattatggtattatggcaaggtaaatcacttaggaagacccaaaattcgctggccaggttgaccggcatcaagtaaagaggtaagaagatgaaagtaagacgtagtaaccggctggttgacatgacgcgctacctgctcgaacatccccgtgaattggtatccctgaagtactttggggaacgttacggctcggctaagtcctcgatttctgaagacttaagcattatccggaccaccttagctgattggggggtcggccgtttagaaaccctaccaggtgcttctggtggtgcacgtttgacgccactgtacgccgaggaaaacgccacccgggttattgatgagctagtggcagccgttaacgacgattcccggctcctgcctgggggctacgtttacttgtccgacttgttagggcgtccggaaatcctccgcgaagttggtcgcttggtggccacccagtacgtcgataaggacgtggacgtggttatgaccgtggaaaccaagggaattccgatcgcccagagcgtggcgatgtatttaaacaagccgtttgtgatcgtgcggaactcgtcacacatcaccgagggatcaaccgtgtcggtgaactacgtgtcggggtcatcgcaacggattaagaagatggaactttcccgccggaccctcaaggaaggggccaacgtggtgatcgtcgacgacttcttaaagggtgggggaaccctcaacgggatgcaatccctgatcaacgaattcggcgcccacttaattgggatgaccgtctttgccgagggtcaattctccggccaacgcttagtagaagactgcacctccttgatcaaggtgacggccgaggacggcgttaacaagaagattagcgcccaaccggggaattacctggccaaggtgtttggggaccaagactaagaaaggatggcaacgatggtaaacaagaacgcaattattctggcagccgggaagggaacccggatgaagtccaagctccacaaggtcttacaccaggtttgtggtaagacgatggtggagcacgtcttgacccaactgcaagcggccgatatccaaaacatcgtgaccgtggttggttacggtgccgacaccgttaaagacgccttgggtgatcaagtgcgctacgccttacaaaagcaacaactggggaccgggcacgcggtgatgcaaacagaagacctgctaggtgaattagctggtcagaccctggtggtttccggggacacccccttatttacggcggcgaccttcaaccacctcttccaataccacgaacaacgccacgcggccgtaacgatcttaacttccaaggcaccggacccaaccggttacgggcggatcgtccgcaacgaaattgggattgtggaacggatcgtcgaacaaaaagacgccagcgttgaagaacaggccatccacgaaatcaacaccggggtctactgcttcgataaccaaaagctttttgcggccctcaagcgcttgaccaacgataacgcccagggggaatactacctaaccgacgtaatcgggatcttaaaggaggaaggcgaaatcgttaccgcctaccaaatggaagactttgatgagtcaatgggggttaacgaccggagcgcccttgccaaagccactaagattatgcaaaagcggatcaacacccagctgatgaaggatggggtgaccctggtggatcctgaaacggcctacatcgataccgacgtacaaatcggccaagacacggtcattgaagggaacgtggtcatcaaggggcggacgacgatcggggccgactgcttgattggcgccggttcgcggattgaagacagcaccttacacgatgacgtgaccatcatgtcttcgaccctggaaaggtcagaggtccactccggggctgacgtgggaccaaacagtcacctgcgtccggaagccgaactaggcgaaaacgtccacgtcgggaatttctgcgaggtcaaaaaggcctacattggagccggaaccaaggtcggtcacctgtcctacattggcgacgctaccttgggtaaaaacatcaacgtaggctgcggggttgtcttcgtcaattacgacggcaccaacaagctccacaccaacgttggggatcacgcctttatcggttctaactccaacattgtggcgccggtcaacatcgccgccaattcctttgtggccgccggttccaccatcacggacagcaccgaacaatttgatatggcgattgcccgcgcccgccaagtcaataagccgggttacgccaaaaaactcccctggtaagagcttgctttttagggggggaataactatcataaaaagtgatgagttaagatctttacgatatcggaggacctaatgaaagaacgttattttgaccctaaattaaagattttttccctcagctccaaccggccgttagcggaaaaaattgccgcctacgttggggtggaactgggaaagctttccgtggaccgttttagtgacggcgaaattcaaattaacattgaagagagtattcggggcgataacgtctacgtgatccaatcgacgtcggccccggtcaacgacaatttgatggagctcctgatcttagtcgatgccctgcgccgggccagcgctaacacgatcaacgtggtgctcccgtactacggttacgcacgtcaagaccgcaaggcccgctcccgtgaaccaatcacggccaagttggtggccaacatgctccaaaattccggggttgaccgggtggtggcactcgacttgcacgccgcccagatccaagggttctttgacatccccgtcgaccacttgatgggtgccccgctgttagccgactacttcattcgcgaaggggtggctgacaagaccgttgttgtttcaccggaccacggtggggtgacccgggcccgggccctggccgaattcttgaaggcgccgattgccatcattgataagcggcgcccgaaggccaacgttgcccaaattatgaacatcattgggaacgttaagggtaagaagtgcatcatgattgacgacatgatcgacacggccggtacgatttccaaggggtctcaggccctaattgacgccggagccgaagaggtttacgcttcttgtacccacgccgtcttgtctggtccggcaatcgaacggttggccaactccccgctcaaggaagtggtggtgaccgacacgattcgcctaccagaagaaaaacaaattgcaaagattaagcaggtttcggtggcaccgttaattgccgatgctatcaaacggattaacgaaaatcgcgcagttagtcccctgtttaataaccgtttccggcaagaaaatattgaaaaataagttagcacagggggcgtggccaggtggtcacgcccccttttccttttgatcaacaatgctagatggggtgaggaatggtataatgtgacaagacaaaggaggaaataagatgaacagaagctttttcaagaaggcaatggtcggcaccgccgccttggcaacggtgttaagccttgctgcttgtggtagcaagggagccagctcttcgtccagcagttcaacgaatgagagctcctcgaccagttcaaaaaagacggtcacggcggccgacaagatcgccgcggcagaaaagttgattgaacagggcaagtaccaacaagccttggacgaagtgaacagcgttactaagtccacgagtgaaagtcgcgcccttgccaccgaccttcaaaactacattgcggctaaaaaggcctacaacaacggcaactacgatcaagccctgacgaacctgaatacggcttcttccagctcctcggccattaaggaagcttaccagagcctgcggagtaagattgcggcggctgaatcaagcagctcgaccacgagttctagtgccacttcttcagcaacgagtgcgacgaccgcggcagctactagtagttccagcagttccgcagccaacgcatctgtggcccaaaggacgagcgaagatgtgattgacgcctttgccactaagatgggctttaaccaacaaggatacggcattatcccggttcaaaagaacgggagcgtttaccgctttgaagtgcggcaaaataaccaggacaacacggtggctaacctgatcgggatttacgaatataacgccgagacgggtagcgtaacgaagatttcttaatgattgggaaaccaacttccctaatcaatgaaccaaaaatagctgaagatcaacgttaaaaaacgtgatctccagctatttttttttggtctcatttaaataaacggtgcgtggcgcaccaatctccgtcctagcttagtcatccgggctgcttcggaggtcagtttccacttcctttaagccaaggcaaacttctcgacggcctcggcgaccccgtcgtggttattgtcggcgaccagttcgtcggccagttgaatcgtcgacgggatcgagttgctcattgccaccccgatgccggcgtaggtgatcatcgattcgtcgttttgggcgttaccaatcgccatcatttcggtacgggcgacccccagttcctggcctagggaagccagcgccgcccccttgctagctgacgggttaacgaattccaggtagtaaggttcggagcggacgatgttaaaggcccgcttaatgggcgccgttagtttagcgctaaagccatcaatggcggctggttcatcggtgatcatcagcttggaaataactaagtcgtttttgatggtgtttaactggtcaatggacttgtaggtgatcggcaaggaaaccaggctcgattcgtaaacggcgtaggaactgatgtcttggtttaagacatacatcgcgtcggcggtttcggccaggaggtggacgtccgctttgagggcaacggcggagaggtcgacgagtttttcaaaggggagggtgaattgggaaattacctgcccggaggtggtttgggccagggccccgttgaaagaaattacgtactgatcagctaggttgttgatgccgagttgatccaagtacttgtggaccccggtcatgggccgccccgtacacaaaaccaccttgatgccttgggcggtggctttttgcagggtctccttggtcttttcggtgatttctaattggtcgttgatcagggtgccgtcaatgtcaatggcgattaatttaatggacatggtctgcctccttagtcgggaatgatgatgtggttgttagaaatgtagtgttgaaactcttggtagatcggctcaaagatttcgatgttgtcgtgttcggccagcatctccttggggaaaaagaagcgctcgtcaccggcttggcgcccggcaattgccgccaccaaagttgacacctcagtgagctcaactaactcgccgtttggttgaattagttcgatctgggattggggtttactgctttgcgggtggtaggtatcgtaaggcaacttgtacgatgagttagtggccgtgtagtactcggcgttaaagcccgccgtagcgatcaggtcggtcagcttctctagtatggcgccggtctggttgtcgtaaagggcggacttgaaggggcgccggtttaaaaagcgccgggccaggtcggctaagatgtcgtcttcacttttggtccagtggatgaagtaggtcgataagaccccatcatctaaggagaggtagtcatccagggtgaaccggttgttgaaaaagggcatcagcatgtagggggtaaaggttggctggtaatcggtggggtgttggtagaggtacttggcccgcttgagcaagtggtctaagatgacttccatcgaccgggaaaccgggtggaagtaaatctgcaagtacatttgcaggcgggagatgatgtagtcttcgaccgcgtgcatcccggagatttcaaaggcgatcccaccttggatgggccgcatcaccgataagacccggtcgaggtcgaacttaccgtagttggtgccggtgtaataggcgtcgcgttgtaggtagtccatccggtcggcgtcgacctggctagagatcatctggactacttgctggttgtgataggtatgatcgatgacgctagccacctgggcggggagatccggggcgacccgggctaagatccgttggatgttggtggtggggctggtaatgaggcggcgggtaatctcctcgtggtcggtgtggaagatgtgctcgaaggtgtgtgagtacggaccgtggccgaggtcgtgtaagagggccgcgcataaggcgaccggtcgctcggaatcatcccaaagcccatcgccggggtggtgagtggggtagttgcgttgaaaatggttgcacatccggcgggcaatttcgtagacccctaggcagtggccaaaacgcgagtgctcggcgccgtgaaaggttaaagaactagtccccaactgcttaatccgccgtagacgctgaaactccggcgtgttgatgaggtcgaggataatttggttatcaacaattatggtccccaggatcgggtcacggaaggtcttctcccggggtagtgcttcatcttgaaatgtcatgattcctccctgtgacgttgtcaatgcccccattatacatgattgtggtaaagttgccgaatagatgacgggtaaaccaagaactgttaagatagggggaaaagggagggcactatgagtgaagtaataccagttcgggtccgtttaaccacccgaatggcccaggatgggcaagaagaaagctaccagtttgaagaagatggtcaactggtgaccctagcaaacgggcaacgctacctgcgctacacggaacaccaggcggggcaagccaccccggtgcaatttcgtttaggtgacggcgccattcagttgacccgcaacgggccggttaaaacccgcctgacctttgaccgcgaaacgaagaccaccagccgttaccacaccccctatgggatcattcagctgacggtcattaccgacgaattggtcgccgaattaaattggccccgggccagtggtagtttacacttggcctaccagttaacggcgggtgaccaattagtgggaacctaccaaattgaattgcggttcgaagcgtgatatgatactatgtaatttagactttttgaagggaagtgcaccaatttggatttaaaggttttcgatggccaggaaaaatcagaactttcaatgatcgaagtggctcacgcaatcttagcttaccataatgaggcaatggcgtttgccgacttgaccaacgagattcaacaataccttggtaaaagtgacgaggaaattcgggaacgactctcgcagttttacacggacctgaacgtcgatggcagctttatttcccttggtgataacacctggggcctgcgtgcctggtacccgtacgaatcgatcgatgaagcaacggttggtgaaaccgaagacgaagaagatcggccaaagaagcgccggcgcaaggtcaatgccttcttggcaggaactgacgacgacgacgatgtgatcgactacgacaacgatgatccagaagatgaagatctggatgatgatcaaggtccagacgatgacgacgattacgaagaagacgactacgatgaggataaccccgttgaagatgatgacgaggaaaccaacatcgaagatcaactgtctgagcttcacggcgacgaattcggcgacgatgaagaagaggacgaagaagataaagaagacgacgaggaataattgctttaacaattgccttgactaatcatggtcgttttcgtattattttacttgggctcccaaagatttgggacactgagtttaaaaatgaacggctccctgtttcacgtgaaatagggagccgtttttattgttgtaaccccggcatgcgtaaaggagagagcatatgacgaagtatatttttgtaactggtggggttgtttcatcccttggtaaggggatcgtggcggcctcattgggtcggctgttaaagaaccgtggcttaaagatcgccatccaaaagtttgatccctacattaacgtggacccggggacgatgagcccataccaacacggggaagtcttcgtgaccaacgacgggactgaaactgaccttgacttggggcactacgaacggttcattgacaacgacttgaacaagtactccaacgtgacgaccgggaagatttactccgaggttttgcgtaaggaacggcgcggggactacctgggacggaccgttcaggtgatcccacacatcaccaacatgatcaaggaaaagattcgccgggccggggaatcaaccgacgccgaggtcgtgattaccgaaatcggtgggaccgttggtgacattgaatcccaaccgttcatggaagcaattcgccagatgaaaaaagaggcgggcgcagacaacgtcttgtacattcacacgaccttagtgccgtacttaaaggccgccggtgaaatgaagactaagccaacccaacactccgttcgcgaactgcgcggcttggggatccagcccaacatcctggtggtgcggaccgaagaaccaatcaccgatgacatgcggaccaagatcgccctcttctgtgacgtggaaccaaaggcggtcgtcgaatcaatggacgccaagaacctttacgaagtgccgttgaacctgcaaaagcaagggatggaccaactggtagttgatcacttcggcttggacgtgccagaagccgacatgggcgagtggaccaagatggtggaccacatcgaaaacggcctgacgaagacggtcaagattgccatggttggtaagtacactgacttacaagacgcctacatttcggttaacgaatcgctgcgccacgccggctacccggttgacgccaaggttaagattgaccactttaacgccgaaaacatcaccgaagataacgtggcagaaaccttaaaggactatgatgggatcttagtgccgggtggtttcgggagccgcgggatcgaagggatgattaccgccatcaagtacgcccgcgaacaagacgtaccgtacatggggatctgcttggggatgcaagtggcctgcatcgaatacgcccggaacgttttgggctaccaagatgcgaactcaaccgaatttgatcaagacactaagcacaacatcattgacctgatggccgatcaagaagacgtggaagacatggggggaacccaacgtttaggtgcttaccaatgccaactgaagccggggacggtagcggccgctgcgtacggtaaccaggaaatgatttccgaacgccaccggcaccgttacgaatttaacaacgccttccggcaggaaatggaagaccacggcctggtcgtttctggggtgaacccggaccgaaacctggtcgaagtggtagaactaccggaaaacaagttcttcgtggccgcccaataccacccagaattcctctcccggcctaaccgtccggaaggattatttgccgcctttgttaaggctgcggcagcggactagtccattagcggctgaaaggcgaaccatttcccgggaaaaggcgggaaatggtgcttggcgttgggaaatgtcggtgggtaaaaaggttaagaatcccgggaaatgcttgtaatttagggccagtttcattatcatgaatattgactgttttaacgccaaaacggtcctcatcaaatgaaatgaaatgtttaaaagcgaggatacctaatcatgaaaaaaatgatcattcaaggagggaaccgactctcgggcgaagtaacgatcggtggcgccaagaatagcaccgtcgcgctcattccatcggcgatcctggccgatactcccgtccagtttgatactgtgccggacatcctggatgttcacaatcttatgattatcttagagtcaatgaacgtgcactcttcctttaagcacggggtgttagacattgacccaactcaaatcattgaagccgaactgcctagcaaggccattaagagtttgcgggcatcgtattactttatgggagcgctactcggccgcttccaccgggcaaccttaaccttccccgggggcgataacattggcccccggccgatcgaccaacacttaaaggcctttgaagccctgggtgctaccgttagtgaaaacaacgggaccgtccacttggaggcaccaaatggcctgcacggaacgcggatcttcatggacatggtgtccgtgggggccacgatcaacgccatcttggcggcggtccgtgccgaaggggtaacgattatcgaaaacgccgcccgggaaccagagattgtggaccttgccacctttttgaataacatgggggcgcagatccgcggggtcgggaccgacgtgattcggattaccggggtgaactccctgcaatcgatgaacacgcacacgatcattgcggaccggattgaatccggcacctacctttcccttgcggccgccatgggcgatggggtgatgatcaataacgtcatccctgaacacttggaagcctacactagtaagttgatcgaaatgggggttgatttgaagatcgattccgataagatctacgtgcctaaggcggagcacttaacggcggttcacgttaagacgatgccgtacccgggctttgctaccgacttacaacaaccgttgaccccgttgatggccaaggccgccggggtaagcacggtggtggatacgatctatcctaagcgggtcaagcacatccccgaattgcaaaagatggggatgaagatcgcagccggcgacggaaagattacgatcgagcacaccgatcactttaacggcgctgacgttgaggccggtgaaattcgggccggggcttccctggtgattaccgggttaatggcagacggtcaaaccgttatccacaaggccgacaacatcctacgtggttacgaccgcattgtttggaagctcaatcgtctaaacgccaacgtccggattgaagacgatgagcaagactaggttgctttttgactgagcacgtgttactctattagggttattgaaataactatgtttcaggcaatgattcatggcaaaaggagcgtattaaattatgaagcaaggaattcacccagattaccacttggtagtcttcgaagactcagcaactggttacaagtttatctccggttcaacggctacttccaaggaaaccgttgaatgggaagatggtaacgaatacccgcttgtccgggttgaagttacgtccgactcccacccgttctacactgggaagcaaaagttcacccaggccgacggggcagtcgacaagttcaacaagaagtacggtttcaagtaaaccaaccttcgttaaagcgtctcacttcggtggggcgtttttttgttgaatcggtaacgccctgattaacaaactaaccacggtgcgtggcgaacaaaaaagactaccctcctttgcggcctggccgacggagcgtggtcttaatgttagtggttcgccttgcgtaggggcaagaagacgttgacgaaaaagagggacaggttgatgaaaacaaaaccggtcgtcaccaagaagaccccggcatagctgaggctgccagcgaccaaaccaccgatgatggggccaaacatgttaccaatgtgcatggcgctttggttccaggaaaagacgtggccagtcaaagtggtcggtgagttcttggttaagagggtctgtacttgggggaacaaggaggcgtcggcgatcccgatgataaagcggagcccggcgagttgccaggtggtggtgacaaaggccgaggggataaaacaggcgatgctgattaaaaaaccgccgattaagatcttttgggtcccaatccggtcacctaaccgccccaagagcggtgcggcaatgatggtggcgaccccgggcatggcggccacgatcccggccatgaaggtgactccctgcccgttatgcatcagctggcggacaaagagggagacgatcgggttgatggaattgttggcggcctggatcgatcagggtcgtaactaggaggcctaagatgacccgcggcagcgccagttggtttaagaccccgctgttgggctgccctggcgttggtttaaccggggcaaagccctcctcgtggaccaaaaaaagggtacctaaaaagactaataataagatgccgccggtgataaaaaaggttgtccggtaagaaaaaattgatgagagggtcccgcctaaaaagggcccaagcaagtttccaccggtcgccccagcggccattaccccgatgtcgccaccactcttttccttgggggtctcggtggcgatcagggcgttggagttggaaatgaaagcggcaaagaccccctgggccatccgtagcccaatcagttgccagacgttggtgactaaccccatcgcccccaaaacgattgccattcccagggcggcgcgcaggcacatcggtttgcgcccgtagcggtccgctaaccgcccccagacgggggagataaaggcggaaacgaagtacatcgccgaaaaggctagcccggaaaagaagttcagctgttggtggctgaagtgaccgagggtggcaatgtataaagaaaggaagggggtcacctcagaaaaccccattccggcaaagaaaacgcccactgaaaggacccgcatgttgcgaacccagacggggcgacgcgatgataccaattcgtaccattcccttatgacatagtgtatactgactttgatattttaacactgacgggagggcatgatgaaaaagaaacgatggtggaaaaccaccttgtactggttagtgatcattttggggcttgccctcagcctggtcttgatctttaatcagcaggttaaagattacctggttaacacttatcaaccacaggtgaccaagtcgctggtggcaaaaaacgagaagaaaaaggccagttacgatttcagcagcgtcaaggacttgaatctacagacggtggccgcggcccgggccaagaaggaatcaattaacgtgatcggggtgatctcgatcccggcgatcaacctgcggatcccgattgccaagggggtttctaacacgaccttggcgctagcggccggaacgatgcgggccgatcaagaaatggggaagggcaactacccactggccgctcacaacatggctaacggctctaagatcctcttttcgcctctttactaccacggtaaggtcggccagttggtctacatcaccgatatgaaaaaggtttacgagtataagttgtacgagcgaaagtttattgacgccacccgggttgacgtgatcgataacactaaggaaaatatcctcaccctggtgacctgtgacgccaccggggcccgacgcttgttgatgcgtggtaagctagttaaggtggtcgcctacgacaaagcccccgccaagatccaaaagaacctaagcggcaagtacacgaatggtcaataaaaaatagttgaagacgacgttgtttagacgttgctcttcagctatttttttgatcgggtgtttagtttaatgggggaaacctttagtctaaccgctcctttacgtagtccaaccagtaagggagggcccgcttgaggctgttgtaggtgtcatcaaagcgtagggtgtaccaagggtcagggattggttcgccctggtggcccggggtcaggtcgttgatggcacggaccttgtcttgttctcctttaggggcaattgtccgcaggtggcgcatgttcatgtcgtccataccaatgattaggtcggcgtcgtaaaagtcttggcgcttaatcggcgttgaccggtggccccggtcatctaaatggtgttcttctaaaatttggcgggtacccgggtggggacggttgccctcttcttcgctggaagtggcccgcgaagaaacgctaacctggtccgttaagtggttagtgaccagtagttggtaaaacatcgcttcggccatcggggagcgacagatgttacctaggcagacaaagattactttcaaaacgtcacgtcctttctaaattcatttccataatacagaaaagttagctggggggctagtggacggcgtttggcttcccttggatttggaaaactgctaaaatagccttagtaacaagaacaaaaggaggacaacgatgaccacaatcattattattgtgattcttgttttattggtggttgcctacgttattatgtataacggtttggttaacctccggacccacgctcaagaagcctggagtcaaattgacgtgcagctgcaacggcgtaacgacttgatcccgaacctcttggagacggtgaagggctacagcaagtacgaagctgccaccttagaaaaggtgaccagtctgcggactcaactggcgagcctgccggatgacgcccaccaagaaaagatggacgtttctaaccgcctgacccaggccctgggctcggtttacgccgtagccgaaaactatccggacctaaaggcctccactgagtatacgaagctgatggaggaattgagcaacaccgaaaacaagattgcttactcccggcaactgtacaactcaacggtcgccacttttaacgcccggattcaaaccttcccctccaatatggtggctaaggttcaccacttcaccgccatggaatacctgcaggttcccgaaagcgctaaggaagcccccaaggttagctttgattaggtaaacgccgatgctttaccaacaaattgctaagaataagcgccggaccatcctggtgatggccggctttgttttcctggtcgccttgatcggggcggcggttggctacctctttgcggggacggccaccggtggggtgatcatcgcgctggtgatcgccgtgatctacgtctcgatcatggtcggccaatcgactgacgtcgtaatgagcatgaataacgcccgcgaaatccattccgccgatgaagcaccagagctttggcatatcgtcgaagacatggcgctggtggcccgggtgccgatgccacgggtcttcatcattgacgacccgagtcccaacgcctttgcgaccggtaataacccgcaacacgcggcggtggcggccacgaccggcttactggcgattatgaaccgtgaggaattagaaggcgtcatggcccacgaaatgacccacgtgcgcaactacgacattcgtttacaaacgattgccttagccctgacggcggcgatctccttgttagttaactttgccggtaactttatgtggtttggggctagtagccggcgcgatgaccgcgaggaaggggccggtggcgtctttgccatcatcggttcaatcctcttgatcatcttggcgcccctagcagctacaatggtccagatggccctgtcgcggcagcgggaataccaggccgatgccggggcagtggagttaacccggaacccccaggggatgattagtgccctgcggcaattacaacacgccgagccgatgcaaaacgtcgacccggccagtgccgcgttgtacatcagtgatccccaggaaaacgcccgtcacaagagtctttcaggcttgtttgatactcacccgccactggaggcacggatcgaacgcttggaaaaaatgtaaaaattatgatggttagaaatgccaaagacgctttctagcaacaaagggagtggttgccacttgtggtgatcactcccttttactgtctcaagttcgccttcccctgcgatcagtgctataatcaattgttagactacgatgcgattagcagatttaagaagaggattaagacccatgaaaatgagcttagctgaaattgcccaggcaattcaggcccacaatcaggttgatcagtggggagacattgaggtgagaagtgtcgctttcgattcgcggaatttggaagcggggggcttgtttgtgcccttaaagggggaacaagatggtcaccaatacgtggccaaggcttttgaaaacggggcgaaagcgaccctgtgggctaaagatcacccttatgatcctgctgatgggtacccacggctcgtggttgatgacccccttgaagctttgcaacaactggggaagtactacctaaacaagattaaccccgttgtcgtggcggtgacgggaagtaacgggaagacgaccaccaaggacatggtggcgtcaatcctggcgacccaaatgaacgtcattaagacctacgccaacttcaacaacgaaattggcgttccggtcaccctcttgaacatggaagccaataccgaagcggtggtggttgaaatggggatggaccgctttggtcaattagacctgttaagccggttgacgacgccggatattgcggtggtgacgatgattggggaagcccacatcgaattctttggtagccgcgataagatcgccgacgccaagatggagatcacccacggtttggccgaagacgggacctttgtttatgacggtgacgaaccgctattgcgggaacgggccgcgaagttgagccaacagactaagacctttggccgccagcttgatgacgacctctacgccactagcgttaacccggacgttgaccacgtcagcttcacggttaaccaatggccggatgaagtcttcaccattccgctggtcggggagtacaacgtcaacaacgccctggccgcaatgacggtcggcaagctgatgcacgtcacccccgctaacatgaagcaagccctgcaaaacgttgagctaaccgaaaaccgctccgaatgggtggccggggctaacggtgaacggatcttgagtgatgtttataactccaaccccaccgccgttaaagaggttttagccaccctagctacgattccggtcgctggtaagcgggtggccgtcttaggggacatgctagaactcggggaggcttccgcacgcttgcacgccggtctttgtgacgccatcatgaatgggcacttagatgaagtctacttaattggtggcgagatgggcgcattaaaagacgccctcttaaaggcgggctacccagcggggcaactgcactactaccaagcggcgcaacgcaaggccctgaccgacgctttgcaagctagtttaacgaccggggacgtggtcttattaaaggctagccacggtctgcatttagaaaaggtgttggcccaactcgaaaagtagggcccctacccaaagtggaaacccagggtggtggactgcggtgagccagttggtcatcagttagttaccacattgctatgtaacattcggaaattaaaaaaaggttgggagaaaacgagtttctcccaacctcgatttattgtaccaatcgaacacatgaggtgaaatatttgtattttagtgaattaggtttatccaacaagttgctcaaggcgatccaacgctccggttacgaagaggccacgccgatccaagaacaaacgatcccgatggtcttagccggcaaggacgtgatcggccaggcccaaactgggactgggaagacggcagcgtttggcctgccaaccattgagcacgttgacgtggaaaaccaggcgattcaagccctgatcatctccccgacccgggagttggccatccaaaccgaagaggaactcttccgcctcggtaaggaaaagcgcgtgaaggtccaagtggtttacgggggcgccgatatccgccgccaaatccgttccttagaaaagaatccccaaatcctggtcgggacgccggggcggttgcgtgaccacttgcgccgcggaacggtcgacttatctggggtgcaaaccctagtcttagacgaagccgatgaaatgttgaacatgggctttttagaagacatcgaagacatcatcaagcaaacgccaagcgaacgccaaaccctgctcttttcggccaccatgccgccggaaattaagcggattggggttcaatttatgcacgacccgcaaaccgttaagatcaaggctaaggaactgaccaccgacctggtggatcagtactacgttcgggccaaggattacgagaagtttgacatcatgacccggatgatcgacgtccaagacccggacctgacgatcgtctttggccggaccaagcgtcgggtcgatgaactatcccgcgggctgattgcccggggctacaacgccgccgggattcacggtgatttgacccaggaccggcgcagcaagatcatgcgccgctttaaggagggccacttggacatcttagtggcaaccgacgtggcggcccggggcttagacatttccggggtgacccacgtttacaactacgacatcccgtctgacccggattcttacgttcaccggattggacggacgggccgggccgggcaccacggtgtctctttaaccttcgtgacgccaaacgaaatgaattacctgcacgaaatcgagaagttaacccgggcccggatgttaccgctgaagccaccgacggaagaagaagccttccgtggtcaagtggccagcgcctacaacgacattgattccttggtggctgatccgacgaccaaccgttacagcgaagacgccgctaagttgttggaaaagtacgacgccgttgaattggtggcggcccttttaaacgacctgactaaagacgacgccagtcaagtaccggtcaagatcacaccggaacgaccattaccaagtcgcaagcgcaacggtagcgggggaaactaccgtcgcggcgggcatggtaattcacaccgtaacttccaccggaacgggggcgatggtcaccggcgtttcaatggtgaccgtaagcggcgcttttcaaacaaccggaaccggcgccgcgaggattaaaccatgattgccgggatcgggattgacgtcgccgagattgaccggatcaagcgggcggtcgaaaagaccccgtcctttatcaacaaggtgttaacgaagggcgaacaagcccagctagcgaccctcaaaaaccagcgctactacgagtacattgccggccgtttttctttgaaggaggcgtactctaaggcgttggggacggggattggccggcacgttagcttcttagacgttgaaattatcgataatgagttagggcaaccggtggtggtaagccacccgtttgacggtcctgcccacgctagcgtcagtcacaccggtcagctagtctttacggaagttattttagaaaaaggggagtaacaatggtaagtgcacggttacgaaaaacggaccttgtcgttgacctcaaggccctaggggcaaatgtacaaaggcaacgggaacaattagctcccggcagccggattttagcggtcgtaaaggccaacgcctacggtaacggaatggtgccggtggcgtcagctttagctagggcgggggtcgaaggtttttgcgtggccctgctcgatgaggcaattgagttacgtgatagcgggattcaagagttagttttagtgctgggcattaccccagttgagtacgcccccctagcggccgcccaaggtatttccctgacggtggggagcctagagtggttaaagaactaccaacggctggcaaaagaagaggggatcaagcaacccctcaaggttcacctggccctagacaccgggatgggacgaattggctttaccacgccggaggactttaaagaagccctgcaattagtagcggcgccctgctttgaatttgaggggatcttcacccattttgcgaccgccgacgaagaggacgccacttactttgagcggcaacgggcccgcttcgatgacttcatggcggtggtaacgaaacgaccgccgtttgttcacgtggctaattcggccaccgggctgtggcaccaaaaatcaatcgtcgccaacacgattcggatggggatttcaatgtacggggctaacccatcgggagtcggaatcaaggaatccttcccgctcgaaccggtaacctccttggtgacccacgcaacctacgttaagcaattaaaggcgggtgagtcggtttcttacggggcaacgtataccgctaaagaagacgaatgggtggctaccctaccggtaggctacgccgatggctatccccgccggatgcaaggcttttacgtcctcgttgacggccagcgctgtgaggtcttgggccgggtttgcatggaccagatgatggttcgcctgcctaaggaatacccggttgggaccgaagcggttttgatgggccgctccttagatcaagaaatcaccgtaactgacgtggcggaatacgcccacacgattaactacgaaattcttaccgggatgggtgcccggcttcaccggcgctacctaggctaggaggggtgtcaatggagcggaaaattagtcggggcgatgtctattacgccgacttaaacccagtcctagggtccgaacagggcgggatccggccggtagtggtggtacaaaataacgttggtaaccgccacagcccaaccgtgatcgtggttgccattaccgcccggatgcaaaaacaccgcctccccactcacgttaagctcaaccaaggggccgccgggctggctcatgattccgtaatcttgtgtgagcagattcgcacgatcgacaagacccggctcaaacagctcgtcacccgcctaccccgagcggtgatggaccaggttgaccaggcgctccgggtaagcttagccgttgagaaataaaactaaaaaatagctgaagatcaacgttttaagcgacgtgatctccagctatttctgttattaagcgggtgttttaggccacccggaggcctagcttagtcaggcggactgccaaggcgtgccgcttccgttctaaaggttcgggtggaggttttcaatttcgatgaccggtaagttcttccggtttaagcgccggacaattttgtcgaccgtttcttgggttacaccatcgggtagggtgattaaaacctgtttttcgtccttggttgggctgatcgacaagacgttagcgatttgacaaaagcgggtgatttccttggcgatggctaccagggtcccccgttcgtcgcggaccgctaccgagaggacgtaggagccggagttaacgttccaagcggtcgctagcatttgtaagagccgattatgggttaagattccgtaaaagcggttgttctcatccaaaacggcgatgtatggtaaatcacggatggtgaaaaagacgttataaaaggcggcgtcctttgagatgaacttggtggcgtttttaagcaacgtcgtcaccggcaaggacatgtcgcccccgcgcgacttgtggcggtaaaggtgcatcttgtagatattgccccgaaagagggtccccgttgcatccaggatcggaacgcaacggtaaccggtattctccaaggtagaaagggcctcggccaaagtagcgttttcagagagggtcgttagttgatcctttggttggatgagggaattaaaaatcatattggttctccttattaagccgttaatgccggataccatcatagcacaaaataatagctaaatgagatctaaatgagagaaaaatacgattctttgggaatcaaccactattaaggtataattgagctaagttcctttaacgtaatatccacgagggatcgacagctctaaatgaggtgaaattaatatgaaaatgatcgttggattaggaaatattggcacccgctacgatgaaacccgccataacgcgggctttatggtggtcgaacaactggcgcgcgacttccacctgggggcttttacccatgaaaaggtggaagccgttaccgttacgggcctaattaatggccaaaaggtgatgcttgtcaagccaacgacctttatgaacgagtcggggcgggcggttaagccactaatggagtactacgatatcgcattagacgacctaatcgtagttagcgacgacttagacatgccggtgggtaagatcaagctcaagcaaaggggagcgtcagggggccacaacggccttaagtcgttaatcgaccacctggggacccgcgagtttaaccgggttaagttggggatcgaccaccctaagtttggctccgtggttagccacgtcctcggccggtttgacaccgaggagcgccccgtttttgaaggggcggtactgcaagctgaacaagccctgattaagtgggtgcaagggactagttttgatcagttaatgaatgaatacaattaaagtggggggagacacgggtgaagttaacggagttggccaagcaacagccagccttttcaaaaattaaggaggtcattgatagtggccagcgccagttgattaccggggtttccgggtcggctaaaacgctcctgttagcggcgctgcaaggggagttgtcacacccgcagttagtggtgtgcgacagtctttaccacatgcaagagctggtcgccgaccttgaaaacctgcttggtgaggaccaggtctttgcctttccggtcgaagaggtgttggcaaccgaagtggcgaccgcttcacctgactaccgcttgcaacgggttcaggccctcaatacccttttggcagaccaagcggccgtcgttgtgacggatgcggcgggtctgcgccggcgcctgcccaaaccgggggatttccaagccgccaccctgacggtcgaagtcgggggtgaacttgatccaactacggtggggacccagttgatggcgatgggctatcggcgccaaaagatggtcttaaaacccggggactttgccatgcgggggtcgattgtcgacatttacgccctgaacacggcccacccggtgcggatcgacctctttgacaccgaggtggattccctacgctactttgacgccgaaagccagcggagcgttgaaaacatccgggcggtgacgatcttgcccgctaccgatttcatcgccccacccgccaagttagcccagctaaagggagggctgcaagacgattaccaccacttagctcaaacggcggatgaagaggaacgccaggccctgtttggcctctttgacccggtcatctccgctttggacgcggggcagttaccagtggaaatgctggagtacgccgaccgggtgtacgaacagccggcctccttgctcgactacctacccgcgaaaagcaacttggtcttagacgactgggggcggattaaggagagcgctaagcgaattacggagcaagaaaccgcctggttgatggataaggtggccgctaaacgccgggtcaggggtgccacccttgataacggggtgatggaaaccctacccaagcgcccgggcccccagacctacctagccctctttcaaaaggggcttggacaagtcaaactggcgcagatctctgacttagcaacgcgggagatgcagcgcttcttttcccaattggaccttttaaagggtgagctcaagcgctggcagtcccagggggcaacggttgtgatcatggccaacagcccggaacgtcgaaaccaagtcgccactaccctagcagactttggggtggcggttgttcaaacggcgcccgaccagctaatggaacaccaggtccagctggtggcggccaccttagctaacggatttgaaatgcccccggctaacttggtggtgattaccgaggcggaaatgttcaaacaggttaagaaccaccgtccacgggcccagaagttagcgaatgccgagcggatcaagtcctacaccgacttaaagccgggcgattacgtggtccacgtgaaccacgggattggcctgtttgccgggattaagacgatggaagtcgatggcgttcaccaggattacatggtgttagattaccgcgacaacgcccagatcttcgtgccagttacccagttaaacctggttcaaaagtacgtttcggctgaatcaaagacgccccgcttaaaccgcttagggggcgttgagtgggccaaaaccaagcggcgggtggcggccaaaattgaagacattgccgacgacttggtcgacctttacgccaagcgcgagaccgaaaagggctttgcctttcccaaggatgactacttgcaagagaagtttgacgatgaattcccgtacgccgaaactaaagaccaactacaaagcatccaggaaattaaggccgacatggaacgcccgcggccaatggaccggctcttagtcggtgacgttggttacggcaagaccgaggtcgccctgcgtgccatcttcaaggccgttgccgggggcaagcaggtcgcctttttggtccccaccaccatcttagctcagcagcactacgacacgatgaaggcccgctttgaaggctttccggtcacaattgccctgatgtcacgctttaagaccgccaaggaattaaaggagaccgaccgggggcttttgaacggcgaaattgatatcgtggtggggacccaccggatcttatctaaagacgtccagtttaaggacctggggctcttgattgttgacgaagaacagcgctttggcgtcaaacacaaggagcgcttaaagcaactcaaagccaacgtcgatgtcttaaccctgacggcgacgcccatcccgcggaccttgcacatgtcgatgatgggggtgcgggacctgtccgtcttagagaccccgccgacgggccgttacccgattcaaacctacgtcttggaacaaaacggcgccgtgattcgggatgggatcctgcgcgaaatgcaacggggcgggcaggtctattacctgcataaccgggttcacgacattgaacgggtggtcacgcagttagcggagctggttcccgaagcccggattggctacattcacggccagatgagtgaaaacgagttggaaggggtgctgtacgattttatccgcggtgagtacgacgtcttagtaaccacctcgatcatcgaaaccggggtcgatatcgctaacgttaacaccctctttgtcgaagacgccgatcgcttggggctagcccaactttaccagattcgggggcggatcggtcgcagcaaccgagtggcttacgcttacttcatgtaccaggaaaataaggttctaactgaacagggcgaaaagcggttagctgccattcgggacttcaccgagctagggtcgggctttaagattgccatgcgtgacctgtcgatccggggggccggtaacctcctgggtaagcagcagcacggtttcatcgattcggttggttacgacttgtacaccgagatgttagctgatgcggtggccaccaaacaaggtaagaagcgaccggttaaatcgaacgccgaagtcgagctcggagtcgaagcctacttgccaagtacttacgtcgacgatcagcgccaaaagatcgaattgtacaagcagattcgccgggccaagagtgaagaagaactgaccgaattggctggtgacctaattgaccgctttggggactaccaaacgccggtggcaaacttattaacgatcgggacgatcaagctgtacgccgaccaggcaatgctaagcgaaattgagcgcaagcgcgataacatttacgtcaactttacggtggttggtagtaaaaaaatcaacgccccacaaattatccaggccctggccaagacccgctttaaggccaccatggatgaaaaagaggacggcgccatttccttacggctggtaatccaaccaaagatgacggaacaggactggttgaaccagctactggcgcttaccagggaattgggtcagcgagtgcaagaagcaaacaatgaacaagaaggggaaaccaagcaatgagattggataagtttttaaaggtatcacgaatcattaaacgccgggcaattgccaaaaagattgccgatcagggacggatcatgatcaacgacaaggtggccaagtcttccagcgacgtcagggttggcgacgtactgacgattgagttcggtaacaagaccgaaaaggtacaggtcaaccagttggtggaaacgactaagaaggacgaggccgccgggatgtacgaaattttagaggaaagctacgccgaagacttcggcaaggaataaatttcgtgatgggaatcgtcaaaaagcatggacactagcggggaaatcttggtataatttttctagtgataggcaaaggagggttcgtatgcaaaagagacaccatcgtattgcggcgctaaacaccatttacgcccgccggatagcggaaaaccgccggtatcgctaccgggttcacgttcgccgggcgaagattatgtactccattattttagtggtggccctgattctcggtttccaactgtggcaaagcaagcaaaccctcgccaaggtcaaccaaaacattgaccagcaacggacggtcctcaagcaaaagcaggcaaccggcaagaagttaaccaagcaaatttcgttgttacacaaccaggattacctcgagcagttgattagatccaagtacaactactctaagactggtgaaacgatttataattttgctgattaaaaaaatccctattcttagtcaagaatagggatttttctcttttcaacgcttgtcaggacccgagggtgtgttatactcaattacaattagtaacaattagaatcgtatgaggaggaaatgcttagttcatggcacttgaagaaggcgcaaaggtttcgggtaccgtttcgggaattacgaactttggagcgtttattgatttagcagataataagacgggactcgttcacatcagccaggtctccgataagttcatcaaagacattcacgatgtcttaacggttggcgataaggtgatggtaaaggtcatgaagattgaaggcaacggcaagatcgccctttcaatgaagcaggctacgccaacggagccggccaagcgtgatcaccacgatcagcaaccaagtgagcggttaagccacggccacgatgaccgccagaatcgtcatcacgaaccccgtggtttctcccgtcccgctcgtggcttcagtggccgggggaattttggccatcacaagccgtccggggactttaacgacatgctatcctcctaccttaaggaaagtgaatcccgtttgtcgaatttaaagcggcaaaccgatggtaagcggggcggccggggtggccggcgaagctaatgaaagaccctaaattaacgatggagcggtcccccctggggagccgctttttttcggcaagcaacaccttagtcgtggccgtctcaaccggggtggactcaatggtgctcttagacctactccaaaacttacctaagttaaggcgtccccgtttaatcgttgcccacgttaaccaccacttgcgtacccaaagcaccgcagaagaagcctttttacgtacgtattgccggcaacgaaaccttcccctcgaagtggcccagtgggcggtcgcagagcacccagcgaagggaattgaagcggcggcccgccggtttcgctactccttttttgccacggtgatggacaaataccaagcccaggcggtggcaacggcgcaccaccaagacgacctggcggaaacggtcctgatgaagttaattcgtggtggtcggatcgaacaattaggagcgctgagatggcagcgcccctttgccagtggcgcactaattcgccctctactcgcgcttaacaaacaagacctccgccgctatgctaaggaccatcagttgacctggtttgaagatgaaacaaaccgtgatctaaccccgtttcgcaaccgggttcggcaccgctaccttccaagcctcagcgttgaaaacccccggctcgtcacggcgctggctagtgacgccgagcaaatcaatgacctcttgggcttggctaacgaacgactaggggaactcgatgccaccctgcggaccgaacggggcttttcgttggccgcctttcgtcagttgagtgaaagtacccaacgttcctacctccgctactacctaaccaaacggggcgttgcaacgattaaagaagaacagcttcaccaactggtaaccgggttaggcgaccaaaccaggccgccccagagcttccaactgcccaatcagtggtgcttggttaagggctaccgggaggccttccttaaaaaagccgggcaaatggcccaggaaggcgaatcggagggggagtttgtggtagaattgggccagtggtatcgtctccgggcgggggggactttttcagtcacccgccagccagaccaagggtcagtgaccacggtttggttgactaacaaccagtttcccctgacttgccgtcccgttcaagctggtgaccggctattgttaaaggggggcacacaccaacgggttcggcgggtcttgatcgaccaaaaggttccccgtgacttacgggcgaaccaacgggtgatcgtcgacgccttaggccaagtggtgtggttagtcggggtgaaggtggcttggtttgaccgccgaccaggggcgctaccggtagcgttatgccaacgagaacaatgatattgagaggaaaagcatgaataacgacatcgaacggatcctttttgacgaggagcagattcaaacgcgagtggcagaactggctgctcaaattaccaacgattaccaagggaagcgcccggtgatcgtatctgttttgacgggagcggttttgtttaccgtcgacctaattaaaaagatcgatctgtacgcggagatggacttcgtggacgtttctagttactacgggggcacggcgtccagcgggaccgttaagttacttcacgacttaaagcactcgattgcgggcaaggacgtcatcatcgtcgaagacattgttgataccggtcggaccctgaagtttttgatggaactactggaagggcgtggggccacgagcattaaggtttgcaccttctttgataagccggccggacgggaggtcgaagtggcgaccgattatgttggttttgacgttccccacgaatttttggttggctatggtctggactacgaaaattactaccggaacctcccgtacgtcggcgttttgaagccggaagtctaccaaaagaatgatgactaattattagtcagcgatggtcagatatggtatattatgaccattcacaaaaacaacaacgtgcagctgttggataggaggttgttatgaataacaatcggaaaaataatggattttcccataacgtcctcttctattcggtaatctttctttgcattatggggattgcttatttcctgtttgggggaaatagtaccaccagtcagagtaaaaacttatcgcaaagcgaatttatttccgcactgaagagtgacaaggtgaaaagtttccagctgcagcctgatgggggagtataccggatcaccgggacttaccgtaaagcgcagcccgtgtcatcgagttccacgacgggcttttctttaggtgggcagagtgcaagctccacgaccaactttgaaagctcggttctggaaagtgacgtcaccatcgcccagctacagaagtatgctgaaaaggaaaaggtggaggtttcaaccaagtcggaagaatccaatagcctttggatgaacctgttagtgacggttcttcccctggtcatcatgattttcttcttctacatgatgatggggcaagctggtcaaggcggtggcggtcgcggggtgatgaacttcggtaagaccaagaccaaaccgtcagacccaaaggaaaacaaggttcgcttctccgacgtggccggggaagaagaagaaaagcaagaactggtcgaaattgtcgagttcttgaagaaccccaagaagttcatgcgcttaggggcgcggatcccagccggggtgctcttagaagggcctccgggaaccgggaagacgctcctggctaaggccgtggccggagaagccggtgttccgttcttctccatctccggttcggacttcgttgaaatgttcgttggggttggggccagccgggtccgggacctgttcgaacaagctaaaaagaccgcaccgtcgatcatcttcattgatgaaatcgacgccgttggtcgccgccgggggaacggcatgggtggtggtcacgacgaacgtgagcaaaccctgaaccaattgctggttgaaatggacgggttccaaggggacgaaggggtcatcgtaatggccgccaccaaccgttccgacgtcttagaccccgctctcttgcggccgggccggttcgaccggaagatcttggttggtcgtcccgacgttaagggccgtgaagccattctgcgcgttcacgctaagaacaagccgttggcaagtaacgtcgacctaaaggaaatcgctaagcaaacgccaggttttgtgggggccgacctcgaaaacctactgaacgaagccgccctcttagctgcccggcgtgaccggacggaaattgacgccgccgacatcgatgaggccgaggatcgcgtgattgctgggccggccaagcgtgaccgggtcatttcaccacgggaacgtaacaccgtggcctaccacgaggcggggcacacgattgttgggttggtcttaaacgacgcccgggtggttcacaaggtaacgattgtgccgcggggacgcgccggcgggtacgccatcatgttgccgcgtgaagacgaaatgctgatgtctaagaagaatgccgaggaacagatcgccgggttgatgggtggtcgggccgccgaagagattatcttcaagtcccagtcgtcgggtgcttctaacgactttgaacaggcaacgcaaatcgcccgcgccatggttactcaatacgggatgtccgataagattggtccggttgagctccagagctccggacaggtcttcaccgggcaaggctacgatcaatcaccgtactccgaacaaacggcggccttggttgatcaagaagtgcgccggatcctgttagaagggcacgaacaagccctgcacatcatcgagacgcaccgcgaacagcacaagttaattgccgaagccctgctgaagtacgaaacgctggatgaaaagcaaatcctcagtctttataagaccgggaagatgccagaagaagatgtggtggcggccgaagatgaacaacacgcccaaaccttcgaggaatctaagcgcgaacttgaacggcgtgaaaacgctaaggctgaagcgactgaagaagacgctgagcaaaccaccagccaaacggagggtgatgagcaaagtactccgcaggcaacggatgctgagcaagacaagcaagctgatcaaaccgatcaaacgaagaagccaaccgaccctgatcaaccagatgattgggatcaccgggaataagcccgcggttggggaataaatggggagcggatgtgaccacagttgttgcacccgcttttcttatggaggaaaaataatggaagactacttagtaaaaagcgtggccgaaaacggtcaatttcgggcgtacgccgttaacgcaacggccctagttgaagaagcccaccaaattcacgatacttggagcgcgtcctccgcagccctgggccgagcaatggtcgggaccttgctgttagcaacctcgggtctgcaaggggaagcggggatgacggtcaagatccaaggtgacgggccggtcggctttatcgtcgttgacgggaccgcccaagggacggtgaaggcctacatgcaaaatccccacgttcacctgcccttaaatgccaagggtaaaattgacgtggcgggtgccgtagggaagacggggaccctgtccgtgaccaagatggccccgggagataagaccccgtacaccggggaagtcaacctggtttcgggtgaattaggtgatgactttacttattacctggcccagtcagaacagattccatcggccgtgggactgtcggtctttgtccaatccgatgaccacattgaagttgccgggggctttttgatccaggttctaccgggagcaagcgacgaagcgatcaaccacttggaaacgacgctacgggaactaccgctggtgtctgacctgctacgggaagggaaaacgcccgaacagattctggagacgatctttgccggtcgtgatttgaagatcctcgaaaagatgccggttgaatacaagtgtgattgctcaaaggaccggttcgaaaaggcattgtccagtttatccaaggacgacttacaagaaatgatcgataacgaccacggggccgaggccgtctgccgtttttgtggtcacaagtaccacttcagcgaagaagaactcaagtacttggtcgcaactaagtaaatgtcggtgaagactaggcgacgacttgctattgatttaaacattgcgatacaatgcaattgcttaatttaaattaggaggaaaacgaatggaatggaagatcgggagcgtcacaatccctaaccaagtggttgtggcaccgatggctggggtcatgaacaccgcctttcgggtgatctgtaagaagtttggcgccggctacgtggtttcggaaatgatttccgaccgcgggattatgtaccacaacaaaaagaccctgcaaatgatgggtgtcgacccggtcgaacacccgatgggactgcaaatctttggtgggaccaaagagaccctggtggaggccgctaagtttgtcgacgaaaacaccgatgccgatgtgatcgacattaacatgggctgccccgttaataagatcgtcaacactgaggctggttcccggtggctattagaccccaacaaggtttacgagatggtttcttacgtgaccgacgccgtaaaaaagcccgtaaccgttaaaatgcggacgggctgggacgaccagcacatctttgccgtggaaaacgccctagcggcacagcgggcaggggcagcagcggtggcaatgcacggccggacccgtaagcaaatgtaccgggggcacgctgattgggatatcttgaaggaagtggccagccagctgacgatcccgtttatggctaacggagacattaagactgctgaagaagccaagtatgtattggaatacaccggcgccgatgccattatgattgggcgggccgccatggggaacccgtggatgctgacgcagacggttcactacttagaaaacggggaactactgccggaagcaacaccggaagaaaaaatcacgacggccaaggagcacttggcacgcctggtggacctgaagggtgaatacgctggggtccgggaattccgcgggcaagcagcttactacatgaagggaattccgcgggccgcccggacgaaggtggccctgatggaagccactgaacaggcgcaaatggacgagatctttgaccggtttattgaccagtacgaagaacgtcaattacaacaaaacgtaaactaggaggaagcacgataaatggcgaatgaagagcatttgaacgaccagatggtggttcgacgggaaaagatgcaggcattaagggaccaaggggtggcgccgtttggtcaccgttttgatccggaccacgatttatccacggatatccgcaagaagtacgaaaacgatagcggtgaattactgttagcccaacacaacgtcgtaacgattgcgggacggatgatcggaaaacggggaagcgggaaggcgtcctttgccgacctattggaccggggaggcaagatccaattctacgttcgccaagatatggtgggggaagaagcctacaagctattcaaagaatccgacttaggggatttctgggggattactggtgatgtaatcaaaacccggatgggcgaactgacggtgcgggccgaaaagattacctttttatccaaggccctccgtccgctgccggataagtaccacggcttgcaggacccagagttagtctaccgtcagcgttacttggacctgatcactaaccgggaaagcttcgaacgtttccaaaccaggactaagattattaaagccgtgcgccgttacatggacgataatggcttcttagaggtggaaacccccatcctagaaaacattgcctccggggctgaggcgcggccgtttgtgacccaccacaacgccttaaacattgatatgtacatgcgaattgccaccgaactacggcttaagcgcctaattgtcggcgggatggaacgagtttacgaactggggcggatcttccgtaacgaagggatggatccgtaccacaaccctgaattcgatacgatggaaacctacgccgcttacttcgacttcaacgacgtgatgaaggaaacggaagggatttttaaggctgccgctggtgtagttgctgatgacttaaagattacctaccaaggaacggaactcgatttcagtacctcctttaagcgtctccacatggtggatgccattaaggaagcaacgggaatcgacttctggcaagaaatgaccgttgaagaggcccgtaagctggctgatgacaacggaattaaatacgagagttggtggaaggttggtcacattattaacgccttctttgaagaaaaggttcaagataccttggaacaaccgatttttatctatggtcacccggtagaagtctcaccgttagcaaagattaacgaagaggattcccgttttactgaccggtttgaactgtacattttgggtaaggaatacgcgaatgccttctctgaattaaacgacccaattgatcaacgcaagcgttttgaggcacaagctcaagaaaatgctgagggtaacgatgaagcccagccgattgacgaggactttgttgaagcactcgaatacgggatgccgcctaccggtgggctcggggtcggaatcgaccggatggtaatgttgatgacggacgcaaagtcaattcgcgacgtcttattatttccaacgatgcgaccaaagaagtagcctagaaataggtgagataagaataagacggtgtaaaaccgtctcatgatcaaaagctcaatcattcggtaacgcgagtgattgagcttttttcccggaatgtcaactcaagcgcaacaccatggagccagaccgtgagctagcttgctagcgcggcctcaataagctcggcggcgttagcgtagccgagtgtcctgcgatgtttttgattcagcgcatcttgaacctttgcgatatcatcttcagagaagccatgtagtgataggcctttagggatgtactctcggatcaggccattctggttttcattactgccacgttcccaaggcgagtacgggtgcgcaaagtagatctgagctccttgaacctggtccaacagtttgaactcagagccgttatcgaaagtgatggtcttaaagtagccaggatgctggtcaatggtggcttgaagctcttttaagcaggtgtctgcgtggtagttgggaatcttgacgatgatctcatagcggactcgccgttcggtcagggtcatcagtgctggttcactggcttgacgcttgcctttaaccaggtcaccttcccaatcaccaaagcgttcacggttattaatagtgtctggtcgttcatcaatcgaagtaccagccagacgcttatttttacgcgagtggttgtgacgattggactttacatggcgccgcagcttggctggcaggtcgatattcttaatgtctaagcggccttgatcaatataccgataaacggtcggcgttgaagggcacggctggtcaggatgagtctgcttaaaggcgtgcacgaaaccatcaacactatcaatccgtggtcgccgtttaagcgctgttttaagcatcttaaagaacaaccagcagaccttttctagtccgccaaaacggcagttctgacgcgctttatcatgaataagctggctcgtgtccgcaaagtatttggtgaaaaagagatagtcagaattacgttgtcgaatggtgccacgcttaatttcacgcgagatcgtgctgcgactgcgattggtcaggcgcgcaatatcagcctgagattttccagcattcaagtacgcttcaatttcacctctttcttccggggtaagttgttgataatgtttggtagtgctatgcttggattgggtcatggagatgtcctttctttagagtttcagcactttaagtttaggtctccatggcctatttgtataatttgaacttgttgcacttagattttaaatccgggattgagcttttttagtaaaaaagttccaattcttttaatccgcaatgttaatattttaacgaatcgaaaaggtcgataagtgctcaggggtctctctattagatataaaacgaactaaaaataaatcaaggagataaatgttcgttatgatttgagaggggcgaaaaagtttgcgtaagccgttgacatagtggggtcgacacggtatatttaatatcgttgtcacaacgacaagcggttatgataattcatcagcttaaaaaagttattgacaatcatttgtaactctgatatactacaagagttgcaaatgcaacggataaccaaaacgatcacaaagatctttaaaaaagttcttgacatcaaaatggttagatgatataattaaaaagctagttaaactcttaacgagttgctggtggtagacctttgaaaactgaataatgtttcgacgaatcaaatgtgtagggtccttgatcttaatgatcgaggcaaaaacatttgcgaagtcaattcgcttaatttattaaaaagagctattcaagcttcttattttatatgagagtttgatcctggctcaggatgaacgctggcggtgtgcctaatacatgcaagtcgaacgcgttggcccaattgattgatggtgcttgcacctgattgattttggtcgccaacgagtggcggacgggtgagtaacacgtaggtaacctgcccagaagcgggggacaacatttggaaacagatgctaataccgcataacagcgttgttcgcatgaacaacgcttaaaagatggcttctcgctatcacttctggatggacctgcggtgcattagcttgttggtggggtaatggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatgcgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctcctttctaaggaattaatcggaaacctacacattgtcgaaacagtgttcagttttgagaggtttacttctcaagatgatttatcatcgcttgttgggcctatagctcagttggttagagcgcacgcctgataagcgtgaggtcggtggttcgagtccacttaggcccatcatggggaattagctcagctgggagagcacctgctttgcaagcaggaggtcatcggttcgatcccgatattctccattgttagccgcaaggttagcgagtttgtactttgaaaactaaataatatcaatttctaataaaatcaagaaaaccgagaacaccgcgttatttgagtttttaacgaattataatcgcatactcaactaacttgactgatctacgatcagtaaggttaagttatgaagggcgcatggtgaatgccttggtactaggagccgatgaaggacgggactaacaccgatatgcttcggggagcggtaagtacgctttgatccggagatttccgaatggggaaacccaatcatcttagtcgatgattacttgagtagtgaattcatagctgccaagaggtagacgcagtgaactgaaacatcttagtagctgcaggaagagaaagaaaattcgattccctgagtagcggcgagcgaaacgggaagagcccaaaccactgagcttgctcagtggggttgtaggactgaactttggagttaccaaagaatcaggtagtcgaagtggctgggaagccacaccagagatggtgatagtccagtagacgaaacctggttctctccgttcaggatcctgagtacggcgggacacgtgaaaccccgttggaatccgcgaggaccatctcgcaaggctaaatactccctagtgaccgatagtgaaccagtaccgtgagggaaaggtgaaaagcaccccgggaggggagtgaaatagttcctgaaaccatgtgcctacaagctgtcggagcccgttaatgggtgacggcgtgcctcttgcagaatgaaccggcgagtcatgattacgtgcaaggttaaggtggaaaaaccggagccgcagcgaaagcgagtctgaaatgggcgtacgaagtacgtagttatgtacccgaaaccaggtgacctacccatgtccagggtgaaggtgcggtaaaacgcactggaggcccgaacccgtgtctgttgaaaaaggctgggatgaggtgtgggtagcggtgaaattccaaacgaacttggagatagctggttctctccgaaatctctttagggggagcctcggaatcgagaatcttggaggtagagcactgtttggacgaggggcccgtcatgggttaccgacttcagataaactccgaatgccaatgatttatgtccgggagtcagacgatgagtgataagatccaccgtcgaaaggggaacagcccagatcaccagttaaggtccctaaatatatgctaagtggaaaaggatgtggagttgcatagacaactaggatgttggctcagaagcagccatcatttaaagagtgcgtaatagctcactagtcgagtgattctgcgccgaaaatgtaccggggctaagcatattaccgaaactgtggatgtgtccttttggacacgtgataggagagcgttctaagggcgacgaagttagaccgtgaggactagtggagcgcttagaagtgagaatgccggtatgagtagcgaaagacaggtgagaatcctgtccaccgaatgactaaggtttcctggggaaggctcgtcctcccagggtaagtcgggacctaaggcgaggccgagaggcgtagtcgatggataacaggttgagattcctgtaccagttaaatgcgtttgaatgatggagggacgcaggaggctaagcaaaccagacgattggaagtgtctggccaagcagtaagtcaggtttagagtcaaatgctttaagccgggttgacaaactgtgatggggagcgaaattaaagtagcgaagttgccgatgtcacactgccgagaaaagcttctagtgagtatttaactgcccgtaccgcaaaccgacacaggtagtcgaggagagaatcctaaggtgagcgagtgaactctcgttaaggaactcggcaaaatgaccccgtaacttcgggagaaggggtgctggtcgcaagaccagccgcagtgaaaaggcccaggcgactgtttatcaaaaacacaggtttctgcaaaatcgtaagatgaagtataggggctgacgcctgcccggtgctggaaggttaaaaggaagagttagcttcggcgaagccctgaattgaagccccagtaaacggcggccgtaactataacggtcctaaggtagcgaaattccttgtcgggtaagttccgacccgcacgaaaggcgtaacgatctgggcactgtctcaacgagagactcggtgaaattgaattgcctgtgaagatgcaggctacccgcgacaggacggaaagaccccatggagctttactgtagcttgatattgagtgtttgtactacttgtacaggataggtaggagccgtagaaaccgggacgctagtttcggtggaggcgttggtgggatactacccttgtattatgaccactctaacccgcaccactgatcgtggtgggagacagtgtcaggtgggcagtttgactggggcggtcgcctcccaaaaggtaacggaggcgcccaaaggttcgctcagaatggttggaaatcattcgcagagtgtaaaggcacaagcgagcttgactgcgagacagacaggtcgagcagggacgaaagtcgggcttagtgatccggtggttccgcatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccactggtgtaccagttgttccgccaggagcatcgctgggtagctatgtatggatgagataaacgctgaaagcatctaagtgtgaaactcgcctcaagatgagatttcccattcctttggaagtaagaccccacagagatgatgtggtagataggatggaagtggaagtgcggtgacgcatggagcggaccattactaatcggtcgaggacttaaccaagtcaggtgtgaggattcttgatgagaaaagatattgtttagttttgaaagcacaagctttcaaagtgtggtgatgatggcctgaaggatacacctgttcccatgccgaacacagaagttaagcttcagcacgccaaaagtagttgggggatcgccccctgcgaggataggacgttgccacgcgttattccggattagctcagtcggtagagcacctgactgttaatcaggctgtcgccagttcgagtctggcatccggagttcttcagatggtgttggtgcgaatcagcatcagcgccatcttttttgccaacttagctcagctggtagagcatctccctcgtaaagagaaggtcggaggttcgactcctctagttggcattttttaattcgccgtcattttcaggggtgtttaaaaccttgatatgacggcgtttctgtttcttattaaacattagtaaacatagttttaaccccaaattggggtcaaaatccaggaagaaaagtttgtgaaataagggaagggcgcaatgtgggctatctgatatagatagctcttttttatttggtcaacttcgacggtgtaaaggtgacctgctccaagaaataagggtccgtgtttggctcttaggctaatttctaaccagcacccgccaccaggcgatcacttgatagggctagggagctgtcagtcggtctaaattctcagccctagcgacaacatgtgtcgttagtaactgtgacggtctgcccccctcgtcagaattcgaaaaacatggtctgcgataaagacgattgcaatgtgtgcgctcttttttgtagcggtcagggggcgggttcatgctaaaatgtttgtgtattgtaatctgtgagaggcggtctcaggaccgtatctttaaccaagccgctaaggctagtggaaccactccagaaatgatccatacggatcgtggagcggcatatacgtccaccaattacaacgaagctctccgtcaggagaaggtaaggcatagcctatcggcgcctgggacaccagcggataacgccgtaatggaacactggtgggcagattttaaaagcatctggctcgagcatcggccaaaggcgcaaactctagcagagttacaggaacaggttcgtgctggaataatatacttcacgaatcagttcatttccgctaaaagaaatgaccaaaccgtggcggaatattaccacgatttggtcggataagaaaaattgtgttttcgtttttataagtgtcaacttgacaggggatagtacccgattaccggttgaatctacaaaatgggagggaaatggatgaataagcaaaaaaataccgacacggccttcttcgggcaaccccgtggcctgtcgacgctgttctttacggaaatgtgggaacggttcagttactacgggatgcgtgccatcctgttgttctacatgtacttcgccgttaccaagggtggtctgggcatggaccaaaccacggcggcatcgatcatgtcgatctatggttccttagtttacttatccggggtggtcggcggttggctatctgaccgggtttggggttcacgcaagaccgtcttttacggtgggatcttgattatgtttgggcacatcgccctttccttaccatttggcgcaccggccctgtacgcctcaatcctcttgattgtttgcgggaccgggttgttgaagccaaacgtttccgaaatggtcgggagcctttacttagaagacgacaagcggcgtgacgccggtttctcaatgtttgtcttcgggatcaacttaggggccgccgtggcgccgtgggccgttccgtgggccgcaagtggctttgggctcaacctctttgggagcgaacaaaacttccacgctgggttctccttagccgcaattgggatgttctttgggttactgcagtactactttgatggaaagaagtacttgtcaaaggacagcctgtacccagatgacccaattgacaaggaaagcctgcgtccaatcatcaactggacgattatcggcctggtagccttagcggtcatccttggcttaatggcggcgatgggacaactcaacgttaccaacgtcattaacctgatcacctttgtagccatcatcttgccaatcatctactttatcatgatgatttccagcaagaaggtaaccaaggtggaacgttcccgggtcattgcgtacgtgccactgttcgttgcggccgctatcttctggggaattgaagaatctggttccgtggtcttggccctgtttgccgaacaacggacggtgctccacattgggggctggcactttgccgccgctaacttccagaccttaaaccccctgttcatcatgatcttaacgccattcttcgtttggctgtgggaccgttggaagaaccaaccaagcgcccctggtaagttcaccgctgggttgatcatcgccgggttatcctacgtttggatggcaattccggggatggtgtacggcactgacggacgggtttccccgttctggctggttggttcctggttcatcgttgaaatcgccgaaatgctgatttcaccaattggactgtccgtaacgactaagctggccccgaaggccttcaagtcacaaatgatgtcaatgtggttcctggctaactccgccgggcaagccgttaacgcccaaatcgttaagtactactcgtcagcaaccgaagttccgtacttcttagccgttgggttagtctcgattgtctttgggatcatcctcttcttcttcatcaagcggatccatggcttgatggaaggggtcgactaaataacataaaaagcgctctccaggtgggggcgctttttgcttgtctaaaaaggcggcagcgcccataataaagtcgtttaaaggagcgaaacgatgaaaattgccattagcagcgataaccacttagacgttaaccgggtggacgtagccgccaccatggaggcccaggccgcctggttgaaacaacaagaagtcgcccactattttttcttgggggatttatttaacgacttcacccggacccagtcctactttaaagaactagcggaccaactaccgggcgtggggattcattacctagctggtaatcacgatatgattaagggggcgagctttgcagaaatcgaagagaatgacgatccgtgctactttcaccgccgctacctcgatttgggtgctaactggcgggtggtgggcaataacggttggtacaactatgacttttccgtttaccacgaccagcccgcggaggtcgccaagtggaagcgggtttactggctggattcaacaatcgaccaaccaatcagtgaccaagcacgcgaggatttggtgctagggcaagtcgccagtcaacttacggcagccaagcgggtcggcaaacaggttctctttttaacccactttgccccccgccaccaggctctgatggttaggccaaccaaggtcaagggaccgcgaatggagcgcttctttcaaatgattcgggccctgatgggggctgatcagttgggcgacttactcgaagcgagcggggtggtacaaacggcttattacggccacctccacggcctgcatccgacctttacccacggcggggtgacctacgtcaaccccgcggtcggcgtcaacaagaagcggatgaacgagtggcaacggccgacatttatggaacaatgggcctggcgaactaaaattgtcgatctggacaaaaaagtttgaaaaaggtcttgcaattatccggaaggttcggtaatataatattctttgattgttaccaaacagtcatgaccttttcggaggagtagcgaagtctggttaaacgcgacggtctgtaaaaccgttccttttggttcggtggttcgaatccactctcctccattttattattgggctatagccaagtggtaaggcaacggtttttggtaccgtcatgcgctggttcgaacccagctagcccaactaattaaccgttccgggattccggagcggttttttgtttccaaagggggattttgatgccaaagcaaggaaaagtagctaaagccagtcgccaggtgcgaattaaaaacggcggggggaaggtcaagcgacaggggcgcttgattgacccggatcagttagagaattttttgctggttcgctacgccctgaccgcccggcgtcacattaatcctagtgagcgggagagttgccaacgcttcctccaggaagtagcgagccgcctgaacgggggcaacgtggtgatggaccaattcagcgcccggcttgtcggtgacttattgccccagctgccctggcagttctttatgcaagtagccaacaattggccaacgttgcgccaattcctcggccgggagttgccggccgtgccactacgagacaggctccgggtggcatccttaccgactgaagcggagtttaacgaactgctagttgccaagttggcccgccaaattgcggcgctgaccctgttaaacaaggctaacagtgccgaccagcgggagatgctggcaaccgcgatgcaacaaaccctgtatcaaaacgggcaaattagctgggcccaggtgcgggtgctgtatgccccgctaggctatacggtgccagaaaacgttgatgacggcactaggcagtggcttttagacttagttaaggtttaaccgttcccgtttacggatccgcgggggcttgttatcatagacacaatacacgaattgatgagtagaaaggatggcacttgccatgcaaaagttctttaccgtacttggtgggatggggaccctggccaccgaaagttacatgcggattttagaccaacggacgccaactaattgtgaccaggattacctcgattacatcgtagttaaccacgccacggtaccggatcggaccagttggattttagatcacgatcaagaaagtccggtgccggttttagtcgaagacgtcaagcaacagagcttactgcaaccagagttctttgttttgatctgtaacaccgcccactacttttttaaggacttgcaagcggcaaccgaaattccgatcttaaacatgctagaagaaacggttaaggagatcaaaaagattaagccggatgctaaaaaggtggggctgttagccacgccggggacggtggaatccgggatttacgaccactacatccaagcggccggctacgaagagttgaagccgacccaagagattttagacgcaaccgaagacctgatctaccatgacatcaaggaggcggggcattccgatggtgccaagtaccacgagttagtccgtaagatggtggaagaacaaggggccgacgtcgtcattttgggctgcacggaactatcctacgctgaggagctgaacccggaaacgacctacccggtggccgattcgcaatccatcattgcggaccggaccttagagttggccctcaagtcgcaaaaggggcgttaaaacgagattaatcaacgggtaatggggaaccgaccacgaaaacgtgaatttcggggccccgttacccctttttgttgccaaatgtttggtagcccatattgacagtgttaaaatgaacatattgaattgattagcgtagtaagggggagcaagcatgggatcaccggtatacattcaaattcataaccaactacgggaaaacattgaaggcggtaagtggcaagtcggcgaaaagattccggccgagcgggaactggcggccgagtttggggtcagccgcatgaccctgcgccaggcgattcaaacccttgttgacgaaggggtgttggagcgtcgggtcgggtccgggaccttcgtggccagccgcaaggttcaagagaaaatggccggcgtcacctcctttaccgacctgatggaggggatgggcaaggtgccgtctagtaagaccatttcctatcacctgaccattccgtcgcaaagtgagatggaaaagttacagttaaagggtgacgagcaggtcttacggatggagcgaattcgctacgggaacgggattccgatctgctacgaggtggcaacgattcccgctcaactagtggcggacttttcaaaagaggaagtgacgacgtcttattaccggaccctggctgagcgctcgcacctctacccggggcacgccattcagaacgtttcggcaaccaacgccaccgaaaagatcgctgagtacctggatatcaagcgcggtgacgccctcttgcgaatgacgcagatttcttatttgcaggatgggcgcccctttgaatacgtccacacccagtacgtgggcagtcgctttgaatttgtcttggaaaaataaggccagactttaatttgtgaggaaaaacaaatggattacaactatcctgatgatagctatacgctacataccgacgcatacgaactctcgatgatgcagacctactataaaaaggggttggccaaccggaaggcggtctttgaagcctttttccggaagatgccctttgaaaatgggtacgccgttttcgccggtttggaacacatcatcacctacctaaagaacctccgcttttcaaagacggacattgactacctgaagacgaccgggcagtttgatgatgactttttggactacctggctaacttccggtttcaagggaccctgcgctcggtagttgaaggggacttggtctttaatcacgagccactcttacaagttgaaggtacgattatggaggggacgttggtagaaacggccctgttaaacatcatcaactaccaaatcatgattgctacgaaggccgcccgaattaagtcgatcgtcggcgaccaaacggtaatggagtttggctcgcggcgggcccaggaatttgacgcagccctgtggggaacccgggcagcctacattggcgggtttgattccaccagtaacgtccgggccggtaagctctttggcattccgatttccgggacccacgcccacgccctggtgcagacctaccgggatgaatacgaagccttcaaggcctacgccgaaactcaccacgactgcaccttcttggttgatacctttgacaccctgcgttccggggtgccgaatgccatccgggtggccaaggaatttggcgaccggatcaacttccagggggtccggattgactccggggacatggcttacctgtccaagaaggtccggaaaatgctggatgaggcgggctttaaggacgccaagattgtctgctccaacggcctcgacgaaaagacaatccaaaacctccagatgcagggggcaaaaattgacgtctgggggattggcaccaagctgatcaccgcttacgaccaaccaaccctgggggcggtttacaagcttactctagtggaagacgaaaccggtaagatggttaacaccatgaagttatccaacaacgtttccaagatgtccacgccgggtaagcaccaggtgtggcgaatcaccgaccgggtggacggcaaaagcgagggcgattacgtcaccttaagtggcgaagatccgcgccaactggactccttatacatgtttgacccgaactatactttcttgcacaagacggttaaggatttcgtggcccgaccgctcttgcaagacatcttcgttgatggccagctggtttacgagcagccagacttggagacgatccgggcttcccgggccacccacttagatcgcctctgggacgaatacaagcgggacttaaaccccgaagtttaccccgtcgacctctcccaaaggtgctacgacaacaagatggcaatgattcaagaaatccacgattacgtcgataagatttaagaggagtaaagcaaaaatgcgtcaattgcaagaacaaattattgaagacctcaaggtgatccccaccattgatccgcaggttgaggtacgacgccggatcgactttttaaaggactacctcaagcaaactaagatggtaaccctggtgctggggatttccggggggcaagattccgccttggcggggcgcttggcccaactggcggtcgaagaactgcgcaaggagtcggggagcgaagactaccagttcatcgccgttcgcctgccctatggggaacaagccgacgaatccgacgccatgatggcgattgacgatttcatccacccggaccgtgtggttaaggtcaacattaagccggccaccgacgcgatggtaatgacactggaagccgccgggactaagatttccgatttcaacaaggggaacattaaggcccgcgaacggatgattgtccagtacgcaattgccggggaataccacggggcggtagtcgggaccgaccacgccgccgaagccgtaaccggtttctacaccaagtacggggatgggggtgccgacgtgacgccgctctcccaactcgataagcgccaggggcgggccctgttagagtacctcggggcgccggaaaagctttaccaaaagaccccaacggccgacctagaagaagaccggccggccttaccggacgaacaagccctgggggtaacctacaaggatatcgatgacttcttggagggccgggaggttgaccaagccgcggccgaaaagatcgaggcctggtaccaacggactggccacaagcgtcacatgccggttgctcccttagacacgtggtggaaggattaaagagtggaaacagaagtactaacccgggtgcaggctaagctcacccaattcaagggcgcccaagtgcgggtggcccttgatttattaaacgatggcaacacgatcccctttgtcgctcggtaccgcaaggaggcgacgggggcattagacgaagtggccctacaaacgattcaagaacaggctaaaaaagagcaggaactctttgaccgcaaaaacgccgtgattaagttgatcgaggcggcggggaagttaacggcaccgctacaagaaaaaattcagggcgccgatgacttagccaccgttgaagacctgtacttaccgtacaagcaaaaacggcggaccaaggcccaagtggctaaggaaaacggtttgatgccgttagctaactggctgctcaagtatgagaccgcggacccgaaaacagaagcggcgcactacgttaatcaagaggtgccagacgctgaggcggccctggccggcgcgcacgaaattctcgccgaggggattgccgaaatggcgacggtgcgcagctggttgcgtaattacaccactgagcacggccggttagaagtcgccgttaaaaaggacggggagcaacttgatgagcgaggcgtttacgagcagtactatgactttagcgagcaggttagccagcttagctcctaccagatcctagcgatcaaccggggggaaaaggagaaaattctgcgggttaaggtggtggccgacccaactacggtaatcaactacctgaacttccgcctggtacgtggccaccagccaaacgccgcgaccgagttggtggaagcggcggccaaagacgcctataagcgctttttgggaccggcgattgagcgggaggtgcgcactaagttaaccgaaggggccagcgcccgggcaatcaaggtctttgggcaaaacctctaccaccttttgatgcaagcgccattaaagggccgggtggtgttaggttttgaccccgcctaccggaccgggtgcaagttggcggtgttagatccccacgggaaggtggaacaaattgccgtcatctacccccacaaacccgccccggaagctaagcgggcccaggccgaagcggagtttttggacctggtggaacgctaccaggtttcgacggtcgcaatcgggaacgggacggccagccgtgaatccgagcagtttgtggctacggccctgcaaaagcttagccggccagtctactacgtaattgtcaatgaagccggggcgtcggtctactcggcctcgccagccgccagagaagaattcccggacctgacggtggaaaagcggagcgccatttcaattgggcgccgcctccaggatccgttggcggaactggttaagattgatccgcaagccattggggtcggccagtaccaacacgacctcccggaaaaggagttagcgagtgagctcgacgccgttgttgaacgggccgttaaccgggtgggggttaatttgaacaccgcttcctaccagctactaacccggatttcggggttgaccaagacgattgcccaaaacatcgttgcttaccgcaatgataacggcgcctacacgaaccggaatcagttaaaaaaggttccccgcctcgggcccaaggcctttcaacaagcggtcggctttttacggatcgtcggtgggcaaaacccgctcgataacaccgatgtccacccggaaagctacccggtggccaagtcaattttggcggcggccgacgtaacggtgaacgagctgggcaccgagcaggccaacgcccggctggctaagcttcagccagcggacttcgtgtccgaaacggtcggcttagcaacggtaaaagacgtgctagaggccctgcaaaagccggggcgggacctacgcgacgggatgccggcgccgttactgcgtcaggacgtaatgacgatggatgacttaaagcccggcatgcaactagagggaacggtgcgcaacgtcgtcgacttcggtgcctttgttgacatcggggttaaacacgatggcttagtccacctatcgcggatggctaagaagtacccgaaggatccgcacagcctactggcggttggcgacatcgtcaccgtttgggtgcacaccgttgataaacagcgtgaccggattcagttgaccatgttgccaccaaagaagggtgacaatgactaaccaagagctccagaacctagtggaacggtggtcgcaagaaagctttgggcgcccctttttgcaccaagcggtctttaaccggcgcttgaaaacaaccgggggccgctaccacttgggtgaccaccacattgacatcaaccccttgatgctagaggagtacgacctagcaaccctcaagcaggtggttctccatgagctatgtcattaccatctccacttaacgggacgggggtttggtcaccgcgatcgcgaatttaaggccttgctaatgcaggtaggggggagccggtacgccccgccgacttccaaggcccggcgcccggggggagtggtagttcgtcaccgctatcggtgcacgggctgcggtctgatcatcgggcgcaaccggcgctttaacctggcccgcttcgtctgccgccgttgcggacaccgctttgaagaaatttaaaaaagttcttgctaacaagtagtatctttggtaagatattatttgttgatgcggcggtggcggaactggcagacgcgcaagattaaggatcttgtggtcattgagaccgtggaggttcgagtcctcttcgccgcactacttaaggctctcggcagatgctgagggcttttttgtttgcctaactaattaagctaataatatttactaaacttttaccaaaaaaccttttaagttcttgttgaaaccgttatcattaatggtaacgaacttaaggagggttatttttatggaagcagagctgaaatggttggacgacccagaagtttttcgggtcaatcaactgccggcccacagcgatcatcgcttttaccgggaccaagaagaagccgctttggaaaagagtagctacgttcagaatttaaatgggcgttggggctttaagttctccaagaacccaatggagcgccccgtcgacttttacaagcttgattttgatcgtaacgactttggtgagattgaagtgccaagtgaaatcgagctgagtaactttgcccagatcaactacaccaacatcacgatgccttggactgggaaaatttaccgccggcctgcctacaccctgggggataacaaggaagagggttcctttagccaggggcaagacaatacggtggggtcttacgtgcgccacttcaccctagcagagggtctcaaaaaccacgacgtccacgtggtctttgaaggggttgaacgggcgatgtacgtgtggttaaatggccactttatcggttacgccgaggattcctttaccccgtccgaatttgatttaacgccgtacttagtagatggcgataacctcttagccgttgaggtttacaagcacgctacctcttcttggattgaagatcaagacatgttccgcttctccgggatcttccgcgacgtcaacttggtggcccaaccaagtatccacgtccaagacttaaagatcgacgcccgggtggccgatgacatgaagaccgggagcctagggctggtgttgaagatggttggccaaccggggagcgttcaggttgaagtcgccgatcaaaccggggccgccgtgctcaaccgccagttaaacgccgatggcaactggacaatggcaccagtccaactggtggggattcacctgtgggataaccaccatccgtacctttaccaattaaccctgacggttcgtgacgctacgggccgggtcgtcgaagtaatcccatatcagtttggcttccgccgggttgaaatcgaccaagacaaggtgctgcgtttaaacggtaagcgcctcatcatcaacggggtcaaccgccacgagtggaattgccaccggggccgggcggtgaccatagaagacatgcacaccgatttgggcatcttcaaggaaaataacatcaatgccgtgcggaccagccactacccagaccaaattccgtggtattacctgtgtgaccgggaaggcatctacatgatggcggaaaacaacttggaaagccacgctacttggcaaaaatttggccaagacgagccgtcatataacgtgccagggtcgcttccccagtggaaagaggccgttgtcgaccgggcccgcagtaactacgaaacctttaagaaccacactgccatcctcttctggtcggtggggaacgaatcctatgccggtgaagacattttagccatgaataactactacaaagaagttgatgatacccggccagttcactacgaaggggtcgtacacaccaaggaatatcgtgaccaaatttccgactttgaaagctggatgtacctaccgccaaaggaagttgaagcctacctgaaaaagaacccggacaaaccatttatcgagtgtgagtacatgcactcgatggggaactccgttgggggaatgggttcatacatcaaactcttggataagtacccgcagtactgtgggggctttatttgggacttcgttgaccaagccattgaagtggtcgacccagtaaccgggcaaaagtcgatgcgctacgggggcgactttgatgaccaccacgctgacaatgaattctcaggtgacgggatttgctttgctgaccggaccccgaagccggccatgcaggaggtgaaatactactatggattacacaaataagctgcacgtcgtttacgacgacaacatcttaggactggacggcaaggactttcagtacctcttctcctatgaacaaggggggccggaatcctttaagattaagggtaaggagtggctttaccggagcccgcgccccactttttggcgggcaacgaccgataacgaccgcgggaacggcttcaacgtctcgtcggttcaatggttagcggccgactatgttttgccgtgccaagacatcgccttacaagtcgacggtaaggataagaagctaccgctagcaccaaaaaccaaccgctattctaaccaagaatttgccaagaaggtcaaaatcacctttacctaccagacccagacggtaccggcgacgacggtccaagtttcctacacggtcaaggctagtggtaagatcaaggtcaacgttcactacaccggggcccagttaccaagcctgccggtattgggttggcggatgatcatgccgacgccggccactagctttgattacgaagggctatccggggaaacctacccggaccggatggccggggggatcgagggaacctaccacgtggaagggttgccggtgaccccatacttggttccgcaagaaaacgggatgcacatggccaataagtgggttcaaattacccgcgccaccaccttgaacaacgccgatccggatgcggcaccgttccgcttgaagtttgaggcccctaagaagggaaagttaaacttctcgtgcttgccgtacaccagcgcggaattggaaaacgccacccacccagaggaattaccagctgcccaccggacggtactggtgattgccggtgaagtgcggggggtcggggggattgactcctggggcgccgacgtggaagaaaagtaccacattgacgccacggtggatcacgacttctcctttaagatcgtgcccgagcttaactaaattcaataacggagccccgtcgtttactaagaaaagcggcggggctttttatcgttttaatcggattttaatatttgatcagcagtgaccgggatttgggtgtaaaatttaaggcatgttgataaaggagcgttaattaaccatgctgacaatcttttgggaaagcctgtccggggtgttggtgatcttgatcatggtggtgtgcggatttgtgatgaacgaacgccactggtttagcccccaatccccgcaaatcatctctaaggtggtaacccaggtcgccttgccgacctacatgatcgccaccattaccaagcagtttacgaccgaccagttaaaaaccctcttgccggacctccgttacccggtgatttcaatgctgatcctttttgccctctcctttgccgttgcccgtgccttggccatccaaaagagccacctcggccttttttcgtcgatgtttttcaactccaacaccgtcttcattggcctaccaattaacatggctctctttggggcgccctcggttccttacgtgctggtttactacatggccaacacgaccttcttttggacgcttggggtgtggttgattcagcgcgacggggtgcacgaagccaaaatcaacgttaaacaggccttgcaaaagattttctcgccgcccttactaggcttcattggtggggttttgctggtggtctttaagattcacttacccaagtttatcagccaaacctgtacctacttggggagcttgacgatccctttgtcgatgctcttcattgggattgcggtttccaacgcgggactctcccgcatccgctttgaccacgacgcctgggggattttactagggcgctttttgtttgccccgtgcttgatggccctgctggtcttaccgagccactcgatgtcaccgttaatgaagcaggtctttatcttacaagcggcgatgccggtgatgaccaacgctccggtcgtttcgcgactgtaccatgccgactcgtcttacgccgccattatggtgacggaaacgacggtcctgtcgattatcgtgatcccaattttgatggtgctgatcaaaacgtttgtctactagtgttacggtgagtgggaaagattaagggaggctggaaaagcggggggttacagcctccccttgcagttacgaaggttagactggaaacggggccaataaccgtgggtctaatacctaagtaggccgaagaacgccgcgttccgcatcaaccgttcgtccgttcttacatacgacctactccggaagttgctcactttcgtaatgattaaccagtatttcccgggaaattagcaagaaattggggggcgtttgcgttatcatggatagggtaagagagggggaaataggatgacaaaactggtgatggtgcgtcatgggcagagtcaggccaacctagacaatcgtttcacggggtggagcgatgtaccactgacggccaaagggattgcccagggtaaggaggtgggggcggaactagttgcccgcgagttcagctttaccgacgttcacacgtcctacatgaagcgggcgatcatgaccgccgattacattttggaggccctggatcagttatacctgccgatccacaaaacgtggcggctgaatgaacgccattacggcgccctaagtggcctcaacaaggaggcggttaaacgagaagttggcgaacagcagttacacgcttggcgccggggcttctttgccgtcccaccccaacttgctcaccccgctcacgaccgccgctacgatcggttaggggtaaaagagccactggccgaaagcctggaaatgtgcctagagcggatccttccctactggcaagaccaggtggcgccccgcctccttgccggccacgatcagttaatcgtggcccacgggagtaccctgcgcgctttggtcaagtacattgaggggatcagcgatgaccaaattgaccaggtggaggtcttaaacgggcaaccgattatttaccaatttgacgaccacctcgtccccgtacacaaggaaattttaatggaggaataactaatggcgattcacgagttaaacaataaccccaccttagccggtcaggtccgcttgattgaaaacgtagtctatggcgcggcggatggtgaagcccagcaaatgtctttgttgaccccctgggcccagcgttatcaggccgcacagttacccgcccgaccattaatcgtttttgtccaggggagctcttggtgcctaccaaccctgggggaagaaattccccaactggtccagtttgttcaccagggctacgtggtggcgacggttcaacaccggaattcacttgatggccacgcctttccggcctttttgaccgacgttaaggccgccattcgttacctccgggcccacgcaacggaatatgccatcgacccggcgcgtgtgtcggtctgggggacgtcttcgggagccaacgccgccatgttggtggggttgaccggtgacgatcctaaatacaaaacggctgccgatgccgaccagtcggatgcggttaacgcagtggtggcctgcttcggtcctaccgatgtggtggcgacctttgaacatagccaaaccgtccccggtagcgatgtcttgcagtattccctgtttggcaccgatcggactaagtgggaccagctcaagcgggaaatgagccccctttaccaaatcaaggagggaaaatcctacccaccgtttctgctcttacacggggatgccgatcaaatcgtgccctaccaacaaatggagcaaatgtatgacgccctgttagcccaccacgttcaagtcgacggggtgcgggtacacggtgctaaccacgaacgggatttttggagtcaagcgatctacgattacgtggcgaacttcttgaagccaattaaccaaccggtggccgattaaagacgtttgaccacgctttttaacattgattataaaaataaaagaggccgggaaaaacggagttttacccggcctcttgctatatatccgaaggttagacagaaaacgtggtcaataaaccgcaggccgtatgcctaagtacggccgaagaacggtgcgtttcgcatcaaccgttcgtccgagcttacatgcgacctgccgaggagattatttcccactctcatagtccctgaggccatggatgaccttagctccatctgttagggtaacaaaaaagttcagaacgagtaattttcgtcctgaactaatcttaggtttaggccaaagttcccattgggtcccacggctttaaaacgactggttcctttgcttgggcggctaagaggtcgtcgctcaagtaagccttgttgatgaccacttggtagcagtacttatccatccaagcgtcggacatgacaaagtagcccttttcgccgaccttgcttccccaggagttttcaaccttccacttggttggctggccgtcaacgatgtcgaccccggtcaaaaccatggcgtggttcatcattgattcgccatagtctaaggagtcggcctttgacatggctagttcggtgtcgaagaggtcttcgtaggcgtaagtgtttaaagccatcaagcctagcttggtttcggaatacttagaaacgtcggagccgaaccaaacgctctcaccgttttcgagttgcttaaccgccaaggccttaaattcatccattggtaggtttaagtgcttgattggccggcccccgaccacgttacccaacatgtcaatcgtgtaggtttggtggtaggacttgtctttagtcggggcctgaatgatggaaacgtagtcgtccaagttccagccaacgtacttttggaagaattcggtcggcgttaagttagcgtcacggtggaactcgtggtcctttttggtccggtactcaaaatcaaaggtagttactggttcgccaaaggcatatgacagcatccggtagacgttgttgagcatcgaccggcgctcttcgtcgatccgggtgggggcgtagttttgttggaccagttgccgtaaaataacggcgtcgtggcgcagctggttatttaaaacggcgttaatttcgcgtgattgagaggagttgtagctttccggcattgcgctttgcggaacgaccccgtacttttcgatcagggcgcacaacatgtcccactgacccccgtcttgttgcggggtttccatcagccaagccaccttccgatcatcgtgaggaaggttggcggtctggatgacgttttcgtagaagtagttggccttttcgaacttgtcccagaagaattggtaggattgggaaagctcaaagtcttcgggcaggttgaacttttgttgcatgtcgtggcgcatcgtgtttaaggccgcaaacatccagcagcgtccggattgcttttggtcggcaacgttaccggtggaaaggtcaatcgaaaagtgttggtcgttgtcggccttggagtgccaatcaaagctagcggccttgaccccgttcttggtgacggctcgctctaaaacggcgctgtccttacgaccggcatagtcttcgtgaaaggccgctaagtcggcggcagaaattgaaaaactcatctaaaaatacgctcctttgttgatttaggacccattataatacgaaatcgggcggcggggtggttagtagggaaagttctctaagcgatcggcggccgagattatccggacaacccggccggggacaccaaccaccagggcgtctttaggaacgtccttggtgaccacgctaccggcgccaatcacggcgccgtcaccaattgtgaccccgcccaagacggttacgttggcccccagccagcagttgttaccgattgtgatcggggcgcccagttcgtagtcgaatagttcgccgtcttcattaacccgggcgttacgttgctggtagcgtaaggggtgactagccgtggtcagggtaacgttgggcccgaacatcacgttatcgccgatcgtcaccgggcaggtgtctaaaacggttaagttgaagttggcgtaaaaattgtcaccaatcgtagtgaagcgcccatagtcgaactggatgggtccttgcaaacaacagttgtgaccgtgctggggtaccaactgttggagcagggacgcccgttttccggtctcggtttctagggtttggttgtaggcggcacacagccggtgtccctcggtgcgaaaggcggttagttccgcactttgcggggtgtagggaaggccttgtagcatgttgttagtgttttcttccattgtaaccatccttttgaaatgaagggcttagggagcggtgagggtggtaatcccggcctcattaccgacgatcacttggttgacccggtttaagaagagaccgtgttcaaccaccccaaccgtgttaatgagatcttcagccagggccagcgggtcggttaacggccccagtttgaggtcgatgatgtagttgttttcatcagtccggtataattgacccgcttcgtccgttcgccattgtggctggtaaccctggtgctcaaacttcgcaaagaccttgcttgcaccaaacgggatcacttccaccgggaccccgaaggcgccaatccggtcaaccaccttggattggtcaacaatccacacgttattggttgaggcgtcgttgacgatcttttcccacaagagggcacccccgccccccttgataccataaaagtcccggtcgacttcatcggcgccgtcaatcgtcaggtcaacgtggtcgacgtcatcgaggtcaacgattttgatccccagggaagtggcctgggcggtcgtccggttggaggtggtgaccccagtaattgctaggccctcttcttggacccgtttgcctagggcgtcaactaaaaaacgaacggtggagccggtgcccagcccaacgatcatgccgtttttaacgagcttggcggcagtttggccaaccaattgttttaaactgtcttgttggttcataaaaattccttttaatcggtaaaagtggtggggaagcgatcttctggcaagaggaccttttggtattcggggtggcgcttgaactgagccacggcgtatgggcacattagtttaatcacccagccctcctctttagcgtgttctacgaaggtcttgactaggtcgctagccaccccggtgccccggtaagtggaagcgacgaagacccgttcgatagcgtaacggttgtcgtaatcagggatggccgggtagtcaagttcgccgacgtattcgccctgatcgttagtcacggttaaaacgttattttcgtatttgtagtgcatcgttttacctccttgtaaaacaagtgttagacgcctttgcctaaattgtgcccgctttaaattcaaatgtcaactcaggagcgaaaccccttccataccgaaccaagctgggtcttgaattttgatggtcgtttagggagtaaccaagtctgaaaccatggtacaatcgaataacaaaattgattttgaggtgaacgaaatgaaacgtgggttccaagtggtctctacttatcaagaggcggggttaacccttcctaagcggcaaacaaagcaggcggctggttacgactttgcggcggcaacggactttacccttccttcaatttggaagggtaacttcattagggccctgtacaagcttcgccaagctaagcgctacttgacgacagaagagcttgaccgggccgataagtcactaaagccgtacttagtgccgaccggaatcaaggcttatatgcaaccagatgaggtcttaatcttagtcaaccggtccagtggccccctaaagcggcggttgattttaccaaacggggttggcatcatcgacgccgattactacgataaccccgccaacgaaggggaaatctttgttcagctggtcaattacggcctgcgcgattatcacattaaaaagggcgaacgcatcgcccagggaatctttgtcccttacctggtggctgaccaagaggaggttccacaggcaaagagaagcgggggctttggttccacgaaacaatagggaggaaccaggatggcaaaagccaaaacacactttgtctgccaaaactgcggttacaattcaccgcgctatttagggcggtgtcccaattgtggccagtggagtaccttagttgaagaagtcgagcaggcaagtaccccggcggctaaaaacgctacggcaaccttaaccgggattgtggcccggccccagcgaatccaagaaattgacaccaaaaaaacgccccgggttaagacccgcttaaatgagttaaaccgggtgctaggtggcggaattgtacccggctcgttggtcttaattggtggggatcccgggatcggaaagtccaccctgctcttacaagtgtcggggcaactgagcgtggaacaccacaaggttctttacgtttccggggaagaatcggcctcccaaattaaattgcgggcccaacgcttagacgtttccggcgaggacttttatatctacccggaaaccaacatggaagccatccgggcgacgattgattccattcagcccgagtttgtaatcattgactcggttcagacgatgcaggcggccgacgtgacctcggcgattgggtcggtctcccaaatccgggcggtcaccgcccagttgatgcagattgccaaggggcaaaacatcacggtcttcgtggttggtcacgtcaccaagggtggggtcttagccgggcccaagatcttggaacacatggttgacacggtgctgtactttgaaggggacctccaccacacctaccggattttacggtcggtcaaaaaccggtttgggtccaccaatgagttagggatcttcgaaatgaatacccgcggtttgaccgaggtcgcaaacccctcggaaatctttttggaagagcggcttaaggatgccaccgggtcggccgtggtcgtatccctggagggaacccgaccgatcctggttgaaatccaggccttgatcacgccaaccgtctttggaaacgcccaaagaacggcgacgggtttaaaccgcaaccgggtttccttgatcatggcggtcctagaaaaacgggcgaacctgctcttacaaaaccaggatgcctacttgaaggcggccgggggcgttaagttagacgagccggccatcgaccttgcgatcgcggtggcaattgcttcttcttaccgggataaggggacccggccgaccgacgccttcgtcggtgaagttggcttaaccggggagatccgtcgggtgagccgaattgaacagcgggtggccgaagccgctaaactaggctttaagcggattttagtgcccaaaaacaatttagcgggttggaacccgccgcaagacatcgaagtcgtgggggtaacgacccttggcgaagcacttaaaattacccttggataggggtaaaattggtagcgaaggggggtgtaataatgaaaaaacggataattcggttagccttcacgattgtgggggcggcgattggcttttactacctgccactgttgtgggcggcaattggctttaagctggccacttcgttgttggcaattgtggacatggtaatcggggcggtgctctttttcttattatcgttatccctagccgactgggtcgccaacctgatgaaacgaaccgaacaagccctagctaagcagaacccgatttacctaatctttggggcgctggccaccattgtcggccttattttagcaattttaatttccattcccctctggcgcacgcgagtgccggtggtgaataatattttgccccttttgttaatggtggtcttttcttattgggggtttcggatcgggacgacccggctcgatgattggcgaaacctcttaggtatgcggcgcgatctcgataaggatacgcagagtcaagttattaaacgtcaagacgataactaccaccactataagattttagataccaacatcttgattgacggacggatttacgacctagttaagaccggctttttggaaggaacgctgttggtccctaactttgtcttgtatgaattacaatacatcgccgattccggggactcgatcaagcgggtccggggccggcggggcttggacattttaaataagcttcaagaagaacggattgcccccgttgaaatgtacgagggcgactttgatgacatcgacgaggtcgactccaagttgattgccctggccaaaaaggtggatggggtaattgtgactaacgactggaacttaaacaaggtcatccagtttcaaaacgttcaggttttaaacatcaacaacctggccaagtcccttcgtccgcgggtaatcccgggtgaacacttaacggtaacggtggtcaaaaaggggaccgagcgccagcaaggggtggcgtacttagatgatggcacaatggtggtggtcgaagacggtcgctacttcatgaacgaacggattgaagtggaggttacctcggcgttgcaaaccgacgccgggcgaatgatatttgcccgtcccctgcattccaccaagggaattgatggtcatcaccacggtcaaaaggaacaatccaagaaatagccttttctttttaaggggggaaggctacactagttaggaaacacttatttttacgaaagaggcggaaatcttgtcaaagaatgaaattcgcgttcgttacgctcctagtccgaccggacacctacacattgggaacgcacggaccgcattgttcaactacttatttgcccggcacaaccacggaaagtttatcatccggattgaagacaccgacaccaagcgcaacattgcggacggggaacgcagccagctcgacaacctgaagtggatggggctggactgggatgaaggtccggataagggcggcgactttggtccttaccgccaatccgaacgtaaggacatctatgcccaatacattcaagaattaatggataagggcctggcttacaagtcctacatgaccgaagaggaactggaggcccaacgggaagcccaaaaggcggcccaccaaatgccacactatgaatgcgaatatgccggcatgagcgatgaccaaatcaaggcggcccaagaagcagccgaagaaaagggattaaagccggtcatccggttccgggtacctaaggatgaagtctttgaatgggaagacctggttaagggacccatgtcgtttgaggcccaatcaattgggggcgactttgtcatccaaaagcgcgacgggatgccaacgtacaactttgctgttgtcattgacgaccacctgatgaagatcagccacgtgttccgcggcgatgaccacgtttctaacacgccaaagcaaatggccatctaccaagccctgggctggaaggtaccggaatttggccacatgtccttgatcatcaataacgaaaccggtaagaagctttccaagcgggacgaatcggtgctccaattcatcgagcaataccgcgacctggggtacctgccggaagcaatggataacttcatcatcctcttgggctggtccccggttggggaagacgaaatcttctccttaaaggaattcgttaagatgtacgatgaaaagcggctgtccaagtcaccagccgcctttgaccgcaagaagctccagtggatcaacaaccagtacatgaaactttcgtcagccgatgaggtcttccacgtggccatgccacagctgttggacgctggtttgattgaaaagaacgccaacccatacaagatggaatggatgcggcggttagtggaactcttcaagcgcgaaatttcttacgcaagagaaattgtcgactacgttaagccgtttgtgaacggcccggaagacatttctgaagaagcgaaggccgaaatgcaagaggacaccgccctggtagtgattaaggccttccgggaccgggtcgccgccatggacttcatggacgcaaccggtgtcttagccgccattaaggacgtgcaaaagagtaccaaggtgaaggggcgcaagctctggatgccactgcggatcgccgtaacccacgaaacgcacgggccggagttaccggaaagcatcgaactttttgggcaggaaaagaccttggcccacttggatgagatgattgcccagttagaagaaaacaagtaagcacattgaaaaaccgtcccttagcaagccagcaaagggacggtttttgttccaaaagagggagcctatggagtcactaaatcaaattaaagcggccacccaaaccggggtgacggagttattagaagccgcccacttaaagcgtggcgacctgtttgtcttggggctgagcaccagtgaggtgcagggtgaacacatcggccaagattccaacattgagattggaaggacggtcgttaaagcgatcgtggaattattggcaccgagggggattaacctggccgtgcaggggtgtgaacatcttaaccgggccctggtggtggaacgggcggtggcagaacaacggggcttggagatcgtgaccgtttacccgcagctgcacgctggtggggccggacaggtggcggcctttgaactctttgatgatcccgttgaagttgaacacgtggtggccgaggccggcattgacattggcgacaccagtatcggcatgcaggttaagtttgtccagattccggtgcggaccagcgtcaaagaaattggccaggcccacgttacttacttacgttcccggcccaagttaattggtggggcgcgggccaagtacgaatgggacccgtttgatcaaaagaaataacaaacgcccagtggggttcggtttaacgaagctcactgggcgttatttttggcaataaaaaagcggtggcttgggaggaccaccgcagaggagtattacgatatcttgggggagatttcgtaaaagtatatttttcggttactattgggaggagtaattgaaaaataataggtttcggttaaatgtagctcgtttccttgctacggtttatatagtatcagttggttgtgaagaaagtatgactaagtgcttaataattatcaaaccccatttctgggttcgccactggtcccgtccaacttgtggtaagatagtactattctagatcgaccactggaggtaatcacatgttgaagatatacaacacactcacccggcaaaaagaagaatttcacccccaacaagcagggatcgttaacatgtacgtctgtggtccgaccgtctacaattatattcacatcggcaacgcccggagcgtggtcgcctttgatacggtgcgccgctacctagagttttctggctaccaagttaattacgtctccaacttcaccgatgttgatgacaagatgataaaggccgccaaggagcaggggatcacggtgccagagttggcgtataagtacatccaagcctacatggaagacaccgccgctttgaacgtcgaacccgccactacccacccccgggcaaccgaaaacattgacgggattatttcctttattgaagacctgattgaaaagggctacgcctaccaaagtgggggcgacgtgtactaccgggcccgcaagtttgcccactatggtcaactgtccggtcagtccctagacgacctggaagtcggggctagcgaacacgtttcaacagaagaggtggccaaaaaaaaggacccgctcgatttcgccctctggaaggcggccaagcccggcgagatcaagtgggactccccgtggggggccgggcgcccgggctggcatattgagtgctcggtgatgtcaaccaagtacctgggtgataccctagacattcacgccggtggtcaggacctcgagttcccccaccacgaaaatgaaatcgcccagagcgaagccaagacgggccaccgcttcgttaactactggatgcacaacggctttgtaacgatcggtagggacaacgaaaagatgagcaagtccctgggcaacttcgtcacggtgcacgacttaattaaggaagttgacccgcaggtgttacggttcttcatgtcaacgacccagtaccggcgcccaattcaatacagtcaagaaagcttggtggaagcccaagctaacttagagcacttaaaaaacacttacgacaacctggcttaccggctcaaagacgctacgtccgggaccgatggcggcgtgcaacggcaactagcggacttccgggcccgctttgtggcagccatggatgatgatattaacgttcaaaacgggattgccgtggtttacgagttgatgcgctttgctaaccagtacgttgaacaacgcctggtgcagcgcgaaccaatcgttgccattcaattaatgttaaaacggttagtagcggtctttggggttgacctggccgtttccgctactgaaattaacgacgaaaaaattaaggaactgatcgaaaagcgtaacgccgcccgggcggaaaaagacttcgctttaagtgaccagatccgcgaccagttaagggaccaggggatcattttagaggacaccccccaggggacccgttacagaaaggaatcaaattagtcaccaatggaacaagcagattatcagcaattgaacgggatcgccctggcctatttgggcgacgccgtctatgaggtgttcatccgccaacacctgttagccctcgggatgagtaagcctaaccgcctgcaaaaaaaggccactaactacgtttcggctaaggcccaggcggccttaatcctcaagatgcaagaagaagactacctgaccgaagaagagtgggcctactacaaacgggggcgtaacgccaacagttacacccacgccaaaaatacctcggtcttaacttaccggcagtcaaccgggtttgaggccctgtttggctacttgcaactagctggtcagcaggagcgggtggccgaactggcggcgtggtgcatcaagcaagttgaacgggggaacctaatccatgaagactaacgaagaaaatagcgaatttatcattgggcgccacccggcgatggcggctttaaagtccgaccaagaaatcaacaaggtgtttatccaaaagggattaaagaccgacgctattgctcagctggtgaagtcggctaaggaacggcacctggtcatttcaaacgttcccaagacgaagctggatcagatgacggccgggcaaaaccaccagggggtggccctggccgtggcggcgtaccaatatgccaccgtggacgacctgtttgaaaacgcggcccaaaaggatgaggaacccttcttcttgattttggatgaattagcagacccgcacaacttgggttcgattttacggacggcggatgcggccggggttcacggcatcattatccccaagcggcggtcggtgggcctgacctcggtggtagccaagacgtcaacgggggcaatcgaacacgttccggtcgcccgggtgaccaacttggttcaggtagctaaagagttgcaaaaacgcggtgtttggctgtttggcaccgatatgcaaggaactgactaccggcgctgggacgctaagggcgctgtggcgctggtaattggtaacgagggaaagggaatttctccactactgaaaaaaacttgtgacgagatgctaacgatcccgatgattgggcatgtgcaaagtttaaatgcttcagttgcggctagtttactaatttatcagggctttgccactcgtcacccgctcgactaatcatgacgacataaaaataagcgaaaacgacccccagtccaagtcggactgggggtttaattgtttgtaagttgattagcgagaaagccaaattggcgaaaccaaattttcgcaatttggctatgaaaatttacaaagtgctaaaacgcgattttcagtatttgtaaacgcttccggactttgataacgtaatttattgcaagggaggagagtaataaatacgggggaggaaaattcatggaagcctatcaattaagtgatgaagagcgggtggagttagctttgattaatggtgcgactaagggtgataatgagacgttgggagaactctttgaccgctaccaaccactggtgcgtcggttgtggttaaattactcaatcgccaacctggatcgtcaggactggcaacaagaggccttcttggttttagaccgggcggtccacaattatcgccaggaacaaaggacgcgtttttgctggtattaccgccagttactcaccaaccgcttgcgcgacttgtaccggcaaacccgggcggaaaagcggatccccgcccaactggttcaagacctcaacgccgaaaacgacgtgacgatgatccaagatccggtgctaaccccagagcagatcgtaatgtggcgggccagctaccaggaatttttggcccagtgttcgacaaacgagcgggaagcctacctactagagagtgagggccgagacttaacggaaattgcgcaggtaatggggtgttctgaacggaaggtgaaaaacgccctccaccgggcccgggcgaagttaaaaaagcaccttggctaggggacaccggttgatcaaaccgggtgattcgtgctaatctagagcagataagggaggcgatggcatggtgaaaaaagtggccctcgagtgcagcgaatgcgggcgccggaactattccgtgcccgcacgtcctaaccacgaggagcgcttggagctcaaaaagttttgcaagcactgcggaaaagtgaccgttcaccgggaaacacgctaattttggaggaaaacatgcacccattgaaatttatcggaagcgttagggatgaaatgcaccgggtggtgtggccaacggcaaaggaaaaccggcgcgataccaccatcgttttatcaattacgatctttttcattctcttctttgccctctttggctggctaattcatcttctgatgttgttattcgtctagctagtcagcgggccaaaagtttgctatactaattgataaggacaaaagcttcgtttgcggacggggtttttttattttgccaaaaacacttctaaaaggagagacatcgtggaaacaaacgaaaaacgttggtatgttttgcatacttactccggttacgaaaaccgtgttaagagtaacttggaatcccgggcccaatcaatggggatggaagactacatcttccaagtggtggttccggaagaaacggttcgccaagtcaaggacggccaagcaaaagaggtcgaagaaaagaccttccctggttacgtcctagttgaaatggtgatgactgaccaagcctggtacgttgcccgaaacacccctggcgtaactggtttcttaggttcgcacggtgggggatccaagccgaccccgctccttcctgaagaagtggatcggatcctagtacggatgggccaagatgttgcccgcaccgatatcaacgttgcagttggtgacaacattaagatcatcgccggggcctttgcggacctgtccgggaaggtgatcgaagtcgaccgcgacaagttgaagttaaaggttgaaattgaaatgtttggccgcttgacgacgactgaactagacttcaaccagatcgatacggtggaataagacttgtaattaggcgatgggtgtgctagattaatacggtatgctatcgtcatactgtgggaggggcaaatttcaatcccccatcattaccacaacacggactaaggaggttttgtctcgtggcaaagaaagtagcaaacgttgtcaagttgcaaattcctgccggtgcagctacaccagctccgccagtaggtcctgcgcttgggcaagcaggtattaacattatgggcttcacgaaggaattcaacgcccggactgctgatcaaaaggggatgctgatcccagttgtaatcacggtttacgaggatcgttccttcgacttcattacgaagacgccgcctgctgcggtattactcaagaaggccgctggtgttgaacacggttccggtgaacctaacacgaacaaggttgcaactgtaaccaaggaccaagttaaggaaatcgccgaaacgaagatgcaagatctaaacgccgctgacgttgaagcagcgatgcgcatgattgaaggtactgctcggagcatgggcttcgttgtcgaaggctaagacccagcagtccgggtcacacgctaaaacgtgctgaccttacgtgggaggtaactccgttcgaccacatatttgcaaggaggaaaacacaagatggctaaaaagcgtggtaagaagtaccaagacgccttaaagaaggttgacagcaagaaggaatacgctgttgacgatgcggtggacttggtcaaggaaatcgacttcgcaaactttgacgcaaccgttgaagttgcatttaacttaaacgttgacactaagcaagctgaccaacaacttcggggtgccgttgtgctcccgaacggtactggtaaggaccaaaccgtaatcgtttttgccaagggtgaaaacgctaaggcggcccaagaagccggtgctgacttcgttggtgaccaagacttagttgaaaagattcaagatggctggctcgacttcgacgttgccatcgccactccagacatgatgccacaagttgggcgtcttggtcgggtgcttggtcctaagggcctgatgccaaacccgaagactgggacggtgacgatggacgtggctaaggccgtttctgacgccaaggctggtcaagttacttaccggactgaccgggacggaaacgttgcggtaccgtttgggaaggtatcctttgacaccgctaagttggttgaaaacctgaagacgatcgaagacgttgttgttaaggcacgtccggcagctgtgcgtggtacttacatcaagcacgcttccatcgcttcaacgttcggcccgagcgttacccttgacctgacgactttttaagttgtcgttcaagtaaaaaagacgtggtaactgtaccacgtctttttttgtgccgttaaaacgaaaatagctggggagccgtagttaaagcggcacgccccagctatttttggttaaagttgtgattcggtaattgattgttcctagttattcatggcgccggtcgatttttttaaccaggtagaaaacggggaggccaacgaccacgatcccgataaataagagtaccccttctggatcgttaaagatttcgctgattaaaacgaagatccccccggcaatggcgaccagcggaacgaacgggtaccacggggtcgaaaagggccgcttgaccagtttgttgcgccggagaatgaagataccaaaaaaggccagggtgtagaagcagtaaaccgtaaagacgcataggtcggacaggtgatcggggtcaaagaagagcatcataatagtggccaagacgatgatgaacagggtggccaccaccgggctctttgacttaggcgttaggtaggaaagggggcgggagaaggggaggtcgtggcgcttagccatggcgtaaacgatccgcggaaaggtcaggatcttaccattgatcgtccccatcattgagacgataatcccgattgataacagcttccctcccatttggccaaaggcggccgtggcgaggtaggaagtggcgttatcgccaagtttgtggatcattatggccggtaagaaacgcagcaccccgaccgtgatcaaggtgtagatgacgaggacggcggtgatcccgatcacgatcgccttgggtagtaacttttgggggtttttcatttccccaccgaggttagcgatcaagatccagccgtcgtaaccaaagagggttgctaaaacggcaaccccgaagccgcccccggcctggctaacttgacccacggtttgcccaaaggcattgtggtgtccccaaagcaaaccgaaaatgatgatggcagcgatcgggattaacttgccggcggtggtgataacggaaaaggcggcgccaaccttgttttcgagcaggtttaaggccccgataaaaaggattgtgatcagggcgaggggaattcgccagtcgctggagaggccaaagaggttggtcatcatgattgccatgaagccagccaccgaagcgatgatggcgggaccataaacgatgacttgcatccacccggctaaaaagccccagattcggccatacagattttcgatgtagacgtacagccccccggtgtagggcatttgcgaaccgatttcggcgatggtaagcccggcggccagggtgatgacacccccaaaaatccaggcgaaaatagccatggtggaagagccggcggagtcaaggacggccccttgtttaaagaagatcccggagccgatgatcgtcccaatcacgattgaaagggccgaccacaaaccgagggatcgcttaagctcttcttgtggttgttcttgcataaccgatgaacctccttatgcgtaatctggaaaaattgttaatattagataaatctatcctaacaaaggtcatagataaaaacaatctagtgtagatatttaataaagttcgcctttatttgttagtaaaagtgaagaaatgaaattttcaccgctaggaaacgaactttgctgaacaatcaaaaaagacttgcaattaaaggtgagccttggtatcctaggggagttgattaaatatgactctgcctaagactcaggtggcgcaagcctcaataccctgccgaggaagaaatgaaatgttccttctctatgtctgccagtcatagggaattttttataaattccaatcaaactaacatgtaggaggtgtaatttcatgagtgaagcagctatcgctaagaaggcggaagaagtcaagtccgttaacgcccaactgttggccgctgaatccgccatcgtggttgattaccgtggtttaactgttgaagaagtcactgacttgcgtaagcaactccgtgacgccaacatcaagatgagcgttatcaagaacaagatcttggaacgggccgttgaagggactgactacgaagacctgaaggctacctttgttggcccaacggccgttgccttttctgatgaagacccgattgcgccagcaaagatcttgaagaagtttgctgatgatcacgatgcccttgaaatcaagggtgggatcatcgaaaagaaggtccaaacgctcgacgccatcaacgaatacgctacgatgcctggtcgcgaagacttgctgtccatgcttgcttccgcattgcaagatccaatgcgcaagatcgcacgggctgtcaaggccgttgccgacaagggcgacgaagaagccgcctaagcgtcatcgttacgttatcgtatcgaccattaacacaattcattacctaaatattggaggaaaataacatggcttttgataaggatgctatcatcgcttccctcaaggaagcttctatctctgaccttaacgaccttgttaaggcaatcgaagaagaattcgacgtttctgctgctgctccggtagccgttgccggcgctgctggtggcgaagctgctgctaaggacagcttcactgtagaacttacttctgcaggttctgctaaggttaaggttatcaaggtggttaaggacatcactggtcttggcttgaaggatgctaaggctcttgttgatggtgcaccttctaacgttaaggaagacgttaaggaagacgaagccaacgacatcaaggctaagcttgaagaagttggtgcttccgttacccttaagtaatcaagcatcatttaaaacactcaccagctttggtgagtgtttttttgttgcctaaggaaagaggcttggttttcctaatcggtaatcaaaaccgtcagttaattagaaatagtgatgactacgatgttaaatgggttagcgggtagtaaaggggtgttgttgaatagctagctcgtttttgtctaaaagtgatatttgattatcgaatgatcattaatataaaaatgaacaaatcgtccgctaaaccataaccgtttttatggtgtcgctaagagaaccttcaaggcgtccccttagccttcgtggtaattaatttcgttattttatgaaaaatcagtcgttgaaatgattagtgatctggtgtattctttagtggaagaagcaattattattaacaggtgataagaacttatcaccgcctatcatttggggaggaactgaaaatgacaattgttagtcttgcacgtttccagttcgcgatgacgacgattttccactatttcttcgttccgttttcaatcggaacggtcttcgttgttgccgtgatggaaacgcgctatgttcagaccaaggatccagcctaccggaagatgaccaagttttgggggaacattttcctcttgagctttgccgttggggtggttactggtttgattcaagaattccagttcgggatgaactggtcggattactcacggtttatgggggacatctttggggcgccgttagcctttgaagccttgatggccttcttcgtggaatccaccttcattggactgtggatgtttacttgggaccgggtaaagaagggcttgcacctcttcttcatctggatggtcttcattgggacgaccgtttcggccctgtggatcttaactgccaactcctttatgcaacacccagttggttacacgatcaaaaacggccgggccgaaatggttaactttggggcgctgctcgctaacaagcaattattattcgaatacggtcacgttgtattagcagcccttttaaccggtgcaacggtcattaccgggttggcagccttccaactgcttaaaaagaagcggacggtttccgacgtcaacaagaagatctaccataagacgatgcggatggggatgtggatgatgctcatcttctcgttggggacgatcttagttggggaccttcaaatgaagtaccttgttaaggaacaaccaatgaagttcgccgctaccgaagcggtttacacgacgacgggtaaaaaggcgccatggtccgtggtggccctggttgacccgaagacccacaagacggaagcaagcattgacattccggacatgttgtcgctactgacttacggtaagacgactggttccgttaccgggatgaaggaaatcaatgctcagcttgaaaagaagtacggcaccaagattggtggccaaaaggttagctactacgttccggttaacaccctgttctggagtttccgggtgatggtcgggtttggtagcttactcttcttggtatcgctttgtggactaattgccaccagaaggggcaggaccgcaatgtacgagaagcgttgggtaatgtggctgtttggcctcttaaccttcagcccgttcctggctaacacgaccgggtggatgatcactgaatttggtcgttacccgtggacggtgtacgggctcttcacgattgcccaatccgtttcgccaaacgtttccgttacgtccctgctcatttctaacattgtctacttcttactcttcactggtttagccgccgtgatgatcgccttgatttgccgggagcttcgtcacgacccgaacgaagttgaagaaggacaattagaaaagcttactgccgatccgtttgcaaagggggccttctaagatgtcagcattacaactcgtatggttcatcttaattgcggtcttgttctccggcttctttttcctcgatggtttcgactacggggtcgggatggccgttaagaccttggcaaccaacgatgaagaacgtacacaagtgattcaaacaattggacccgtctgggacgggaacgaagtgtggttaattaccgccgggggggccatgtttgcctccttcccgtactggtacgcttccctgttctccggttactacctggtgctcttgttcattttggttggcctgattattcgggggatttcctttgaattccgggctaagagcccagctaagtacaagcacgtttgggacaccaccttggccttggggagtttcattgtgcccttcttattcgggaccctgttcatctcgatgattaaggggatgccaattgacgcccaggggaacatgcacgccacgttctttgactacttcaactggttctcgctcgttggaggggtagccttgaccctcttgacctacctacacgggttaaactacctaaccttgaagacggtgggaccaatccacgaacggtccaagagttttgctaagttgctttattgggtcctttacgcgggtgaagtggtcttcgccctactgttgatcttccaaaccgactttatgaagcttcacccggccggcactctgatttgcctggtcttaatcgtggccttctccgtgatcgcccacgttggggtgatcaccaaccggcagggaatggccttcatttccagcgggttgacgatggtcgctttggtggtgctgttgttccaaggcctgtacccacggctgatggtttcttccatctcctcttcgtacgacctgttaattaagagtggttcctcgtcgccgtacacgctggtgatcatgacgacggctgcggtaatcttagttccaatcgtgttactttacacggcttgggcttactggatcttccgtaagcggattgaaatgccagccattggggggagtaactaatgattgatcgtgccctatttaaattaccgggtgcccgatcaatgatcatggggcttgtgggactcgatgtcctacaagctcttttgattatcgttcaagcactcttcttgagtcagtcaataaccgggttgtggcagggtcacgccctaaagacggtggcgggtccgattacttactttgcactgtgtttcattggccgccagttaattaactggttcaacgcccggcgcctggacgattttgccgggtccgtggccaaggatatgcgcaaacaactgctacaaaaagtcttcgcactcggtcccgaagcggtggccaagaaggggaccgggagtatggttaccgttaccctcgatgggatttctaacgttgaagattacctgcaactgaccctgtctaagatcgtgacgatgatgatcactcctgtcatgattctgattgcagtagcctttttaaactggcaatcagccgccatcatgttggtgatctacccactcatcatcctctttatgatcatcttaggttacgccgcccaggcccgggccgaccggcagtacgaaaattttcagcgcctctccaacaactttatcgactccttgcggggaattgataccctaaagtactttggcttgtccaagcgttactccaactcgatctttaagtcgagcgagtcctttcgtaagtcgaccatggacgttttaaaggtcgccatgctatcgaccttcgcccttgatttcttcaccaccctatcgattgccatcgtggccgtgtacctggggtttggcttgattgacgccgaaattccgcttttcccggccctggccaccttgattttggccccggactactttttaccgatccgcaacttcgccaatgattaccacgctaccttggacgggaagaactcctttcgagacgtgatggaaatcattggtcaaaagcaagcccccgcaccagaatttaagctgcacgcctggcaagctgatgaccagttagaaattaacgacctggccttccgttaccacgaggggggcaagatcgccccgttgtccgttcggttgcgtggctatcaaaaggtcggaatcatcgggatgtccggttccggtaagaccaccttaattaacctcttggcgggctttttaacgcctgagcaaggggagattaagtttcagggccaaactagtgcgacgatgaacatcgccgattggcaacaccaaatcacctacatcccccaaagcccctacgttttcgccgctagcttacgggataacgtcgccttttacaccccgggggtttccgatgaagaagtgaaggatgccatccacgtcgttggtctcgatgacctgttggctgacctaccagcgggcttagacaccatgattgggggcgggaaacgagccctttccggtggccaagcccagcggattgcgttggcccgggcttttttggaccacaagcggcgggtgatgatttttgacgaaccaaccgcccacttggacatcgaaaccgagctagacttaaaggaacggatgttaccgttgatggaaaaccgcctggtcttctttgccacccaccggttgcactggatgaagaagatggactacatcctggtgatggaccacggtcaactggtcgagcaggggacttaccaagaactgttggccaagaatggttacttcaccaagctgattcaacaaacgaagggagagggggagcaagatgttcaataaagttcgtctcttacgggatttgaaaaatgaccaatgggtgcgcccctttttgcattactacaaaaagaccctgtggctagccctgacgctcggggtattaacctttgtctgtggggccgggttgatgtttgactccggttacctgatttcaaaggccgccacccacccggataacatcctcttgatctacgtaccaattgtcttgacccgggcctttgggattggccggccggccctacgttacgtggaacggctggtcagccacaactgggtgttaaggatgacctcggcctttcgcaagaagctgtatgattccttagaaggtgacgccgtcttctttaacagtaagtaccagctgggcgacatcttggggctcttatccgaagacgtttcccacatccaaaacctctacttacggacggtttttccgatgatcgtttcctggagcctgtacgtcatcatcgtggtggggattggctttttttcacctttgatggggctatgggtgctaatcacctttggcctaatgatctttgcgattccactctggtccgtcatcattaacggggcccggcaggcggtggaaaagaagactaaaaatgatctctacaccgacctaaccgataacgtgatgggaatcaccgactgggtcctggccgaacgggggcaggaatacgttaacttgcataaccaacacgaagagcagttgatgaaggtgcaacaccggatgcaccggtttgaattcttccgtaacttcgttttgcaaatgctattcatcctaatcgtggtcagcttgctcttgtgggccgggacttactttggcgggcaatatgggggcccggctaactggatcgccgccttcgtcttagcggcctttccactggtcgacgcctttgccggtttaccggatgcggcccaggaaaccaacatttacgccgattccttggaacggttaaataacctgcctaagccacaagctaccccagaaaccgccgtggccctgaatggcccgttcacggtcaaggttgaagacgtccactacacctacccgcaaacaacgcgcgaggtcttaagtggtattgatttaacaatcacgcccggccaaaagctggccattcttggtcggtcggggtctgggaagtccaccctcgccgccctgttgcggggggaccgaacaccaaccaaggggcaaatcaccttaaacggggtagctacggccacgttgggcgaccaggtggccgattacgtaggggtgattaaccagtcacctcacctcttcaatacgacggtcgccaataacgtccggatcgggaatgagaacgccagtgacgagcaggtgtgggacgtgctcgaacgggtggggttagccgagatgatcaagaagcttccccaggggctggagacccaggttgacgaagccggcctccgcttctccggtggggaacgccaccgcctatctctggcccggatcctgctaaaagacgctccaatcatcctattggacgagccaacggtcgggctggacccggttacggaacaggaggtcttagacacctttatgacccagttacagggcaagaccctaatctggattactcaccacctccagggggtcgctaaaatggatcaggtggtcttcattgaagatggtcacctcgccatgcaggggaccccggcagaattggaagtcagttccgcacggtaccgtcacctactggcggccgaccggggtgaggagtaaacgaatgaaatgatggctgagcggttgggaagtaccctcctgacaagattataggtaaggtcggacgaagactaaggcgttacgtaccatttttcggccttcttaggcacttggcttgcgattataacattcatgaataaagtaagaggccgggagaagcctgttttctcccgaccttttttattttcttccgggagctaggggcggcccaaaggtatttggtgggtaaaattagaccaatattttttggtcagtaaacaaattcaattattcacataatcttgaaaacgctttctcacttacaagacgggttaacgattttatgtcttgaaatttaattcacaatcaatccaataaaaagccattagaccttgttatataagggggaaaaccttgttgactaaatcacaaaaatggattaatcttataaccgtaaacaagttaatttcttcacaaaacctgaggaggaatctttaaaatggcgaagcaaagtgaaccacaaaagatgacgaagaccgaaaagatggtggacgacctggtccaaaaggcccaccaagcgctcgatatcatgagcgaattcgaccaaaagaaggtggactacattacccaccaaatggtcgaggctggccaagataagcacatggaactggcgatcgaagccgtcaaggaaaccggtcgtgggatcgtggaagataaggcgatcaagaatatgtttgcgactgaagaaatttggcacaacattcgcaaggaccacaccgttggggtaattgaagacaacaaggccgatgagttaattacggttgccgaaccgctcggggtcttagccggaatcacgccggttaccaacccaacctcaacgacgctgtttaaggccatcattgccatgaagacccgcaacccaatcatcttctccttccacccacaagccttggaatgctcccgtcacgccgctcgaatcgtgcgggatgccgccatcgccgccggggcaccggaaggagcgatccaatggattgacgaaccaagtcgggaatcttcaaccgcattgatcaacaaccctggaattgcctgtaccttagctactgggggccccggcatggtgagggctgcttactccaccgggaagccagccctgggggtgggacctggtaacggtccggtttatatcgaaaaaaccgctaagattgcccgggctgtcaacgacattgttttatccaagacctttgataacgggatgatctgtgccacggaaaactctgccgttattgaccacgaaatttacgatgaagtgaaggccgacttgaaggcgaaccgtgtctacttcgttccccaaaaggaacacgctaagttgcgcaaggtaatgtttaacgaacaaaccggtggggttaacggcccgatcgccggtaagtccgctatgcaaattgccgaaatggccgacattaaggtgccagaagacacccaggtcctggccgtcgaagttaatgccattggtaagcaagaactactctccggtgaaaagctgagcccagttttgtcggtttacaaggccatggatcaacaagatgcctttgataagtgtgaagccctacttaactacgggggactgggccacacggctgccattcaaacccaaaacatggacctagctcgtgaatttggggtggcgatgaaggcatcacggatcatcgttaactccccgtccggactcggtgggattgggaacatctacaaccggatgaccccatctttgaccctagggactggttcatggggggagaactcgatttcccacaacgtgaccgattacgatttgctaaacgtaaagacaattgccaagaggcggaataacatgcaatggattaaattaccacggatctacttcgaacgcgattctgttcgttacctcaaggacatgccagggatcaagcgggtcttcatcgttactggcccatcaattcaagcccacggctacgttgatgtggtgaccgaccaattgaagctgcgggaaaacgatgtccaatacctggtcttctccgatgtcgaagccgatccatccacgacgacggttgaaaaaggggtcgccctgatgaagagcttcaagccggacacgattatcgctttgggtgggggttcgccgctggacgccgccaaggggatgtggatgttctacgaggacgaaaatgcttccttcttcggggcaaagcaaaagttcttgaacatccgtaagcgggcctaccgcttcgacaagccgaagaaggcccaaatggtggcgatcccaaccacttccgggaccggatccgaagtaacgccgttcgccgtgattacggacgccaagacccacgtgaagtacccactggccgattacgctttgacgccggacgtggccatcgttgacccccagtttgtggacacggtaccaaagggcaacatcgccgcttccggtttggacgtcttgtgccactcgattgaatcctacgtttccagcatggcctccgattacacccggccgctgtccttgcaagccatcaagttagtctttgacaacttaaccgcttcgtacaatggggatgaagaagcccgggctgccatgcacaacgcttcgaccttagccgggatggcctttgggaacgccttcttagggatcaaccactcaatcgcccacaagctgggtggtgagtttggcctgacccacgggatcgccatcgccatcacgatgccacacgtcatcaagtttaacgccaccctgccaaagaagtttagcacgtggccgaagtacgaagccttccgggccgccgatgactacgcaacgatcgcccgcacgatcggtttgaccggcgactccaacgaagagttgatcaacaagctctgcgacaagatcaaggacttggcccactcgctgggtgtaaccctgagcttgaaggcctggggcgtcgacaaggctcacttcgacaaggtggttgaccacctagccgtcttagcctacgaagatcaatgtacgacggctaacccgcaagaaccactgattgccgacctgaagcaaatcatgatcgacgaatacgacgggaagggcgtcgaaaccaagtaagtacgaaaagtggggaatgatctcttgggcctgcttagacactaggccgttaccacaatttctgtctaacattcgggaatacagcaaggggccgggaaaacagagctttttccggcccctttaggttaaaggactctaatttactgattgacatagcggcgcccctccgttattctagaaataagttaacaacgaaagaaacacggtgaacaggagagtaactcccgttataaaccagtaagcgagccccgttgagtggaagggggtctggtttggagggagcgaaagtagcctgggagtggtcgatgcgaagtttgagtgtcgaacgggtgcgcccgtaatcgcgccggcgtattccgcggagtacgcgttgaggcggggccagcgatggtgccgtaaatcaagggtggtaacacgcttaggcgtcccttcaggttaatgacctgagggggcgccttttttctttcgttgggatctgaacttagctaagttctctgacgtaagcatttataaggaggaccaactcatgaaacaaacattatcaattcgcaaatacctattaatcggctcgttaattttcgggatgctgtttggggcgggaaacttgatctttccggttcacctgggccaaatggcgggggcctactggttggcggctactgggggctttttgttctccggggtgttgctaccgctgatggcgctcctggcgatttccattacccgtgctaaggggatttacgacctcgcccggcccaacggacactggtacgccttgctctttttaatcctggtgcacgccaccctggggccgctctttgccaccccgcggacggccaccgttccgtacacgatcggctttgcctcccatatcccagcgaacctaaactgggtgggtctgttgatctattcggtaatcttttttggcctggtttactacttctcctcaaaggaaaccagcattacgaccatcattggtaaggtcttaaacccgctcttcttgctaatgctgctggccattttcttactcgccgccatcagcccgctggggaaggcgtccaccaccacgatcacggcggcttaccaacacgcggcctggacgaacggcttcttgcagggctacaacacgatggacgccttggccgcactggcctttggggtgacggtgatcaccgcgatccggtcctttaagcttaaaaacgatcgtcaagttgcgattgccacggccaagggtggggccgttgggatcatcgggattgccctgatttacatcggcctgatttacttaggagcgactagcttacatcactttacaatggccgaaaacggggggatcaccctggcgcagatcgctcacttttacctggggacctttggcgacgccctgttagccaccctagccacggttggctgtttgacgacggcgatggggctggtggtggcctttgcccaggacttccacaagcgcttccctaaggtttcctaccagcgttttttactctttaactgtggcctgtcctttgtggtggccaacctcggtttgaaccggatcatcacctggtcgacgccggtgttgatgttcctctacccgttagcaatcacactgattatcttaggaattgcctcgccactctttaataatgaccgcttggtttaccggctgaccactgggttaaccttgatcccggccttcttcgacatggtgaacaacttaccagtcatcttacgggcaaccgcaccagctcaatggttgatcaacctagccagtcacttcttgccgtttttcaacctcggctttggctggctgacctttgggattgccggcttcgggttgggcctggccggccacttcctgttgaaccggcaagctagtacggcgccgacgatgcagggggaacgagactaggtgggatccaattcatttaaccataataaaacacccgtcatggccgtgaccatggcgggtgtttttacgcgggtgtttttacttgaaattagtccttagcgttaatgtccttgccggcgttcgggtcggccacgtggtagtcgctgtcgctcattgcttcaacggcccccaggcggtaaccattcccaacttggctgaagaagtcgtggttggacgtggtcgtggagatcccgttcatgaccactgggttgacatcggaagccgtgtcagggaagagtgggtcttgaccaaggttcattaaggccttgttagcgttgtagcggatgaagaccaagacgtcatcggtccagccgatttggtcgtataagacgtgagtgtacttctcttcgttgtcgtaaagttcgtacaagaagtcgtacatccaacgcttcatgtcttgttgttgcttttcggtcagttggttcatgccgacttggaacttgtagccaatgtaagtgccatggacggattcgtcccgcaaaatcaacttgatgatttcagcaacgttgttaagcttgttgtgccccaagtagtacaggggggtgtagaagccggagtagaataagaaggtttccaaaaagacgttagccacctttttcttcagcgggtcttcttgggcgtccaagtagaggttaccaatcttaacggccttgttttgcaggtattcttcactatcggaccatgagaagatttcatcgatttcgtctggcgtgtttaaggtggagaaaatcgttgagtaagacttggcgtgaacggattccatgaattggatgttgtttaagaccgccgtttcgtgaggggtcttaacgtcttgtttcaaagcggtcagcccagcttctgattgcaaggtatccagcagggtcaagccaccgaagacgtggccaaccgtccacttgtggtcgtcgtctaattcgcgccagtcatccaggtcgtttgaaaccgggatccgggtgtctagccagaattgttccgtcaacttctcccaggtcgccttgtcaatcatatcggacacttggttccaattgattgctttataattcttaattgccattcgattaatctccctatcaattaatttgttaatgtgaacgatttaattatgactgatcagcttaaattacgcaagattcacattggttggcgccgacttcttcgttatcatccgtgaaggtccggatgtagtaaatcgacttaatgcccttttggtgggcgtagtgacgcaggatgttgaggtcgcgggtggtcatcttttccgtccgcccgtccttccattcatacatgccggctggaatggtcgagcgcatgaacagggtcatcgacagggactggtcgacgtgttcttgggcggcggcgtaggtatcaatgacgctacgcatgtccgtgtcgtaagcggagcggtagtacggcatcgtgtcgttggataggtatggggccgggtagtagaccttaccaatcatcttttcttgccgttcttcgatccggttgatgatggggtgtaggctagacgtggagtccccaatgtaagaggtcgagccgttcggtgccacggcgaggcggtaggcattgtagagaccggattcttgaacccgttgcttgagttcttgccagtcgtctggggttgggataaagaagccggcaaagagttccttaacggcggcggactttggtccccagtccttagtcaggtacttgtcaaagtaggaaccgtcagcgtaggcagaccgttcgaagttggcaaaggtttcacccttttcctgggcgatttcgttagaagccactagggtccagtagtttaaaagcatgaagtaaacgctggtgaactcaagggcaaccggagaaccgtacatgatgtggtgcttagctaagaagccgtgtagccccatcgctcctaacccaaccgagtgggaaaggtcgttgccgtgcttgatggatgggactacggttaagctttcagcatcggaaatgtgggtcagaccacgcatcatcgccctaacggagcgtccgaggtctggtgtttccatcaggttagcgatgtttgtggaaccgaggttacaagaaacgtcggtgccgagggtttcgtaggtttggtcatcgttgacccgggacggaatctgaacttgggcaatttcggaacagaggttggacattacgattgttccttcaattgggttggccttgttaaccgtatcgacgttaacaatgtatgggtagccggattcttgttgtaacttggagatttcgtcttccaactcacgggcgttgaccttcttcttggtgatttcagggttagcaaccaggttgtcgtattccttggtgatgtcaacgtaagagaaaggcttaccgtagattcgttccacgtcgtacggggagaagaggtacattggggcgtcttcttccactaactggtagaacttgtccggcaccgttacccccagggaaagggtctttaagcgaaccttttcgtcggcgttttcctttttggcccccaaaaagtcaatgatgtcggggtggaagacggagaggtaaacaacccccgctccttggcgctgccccagttggttggagtatgaaaaggcgtcttctaagagcttcatgaccgggacaaccccggaagcggcccccttgatcttcttgattggggcgccggcttcgcggaggttatttaagttgatgccgaccccgccaccgatcttggatagttgcaaagcggagttgatcgtccgcccgatcgtgttcatgtcatcggtagcttggatttcaaagcaggaaacgaattccccgcgccgcttgcgaccaacgtttaagaaggttggcgtggccggttggtagcgttggtggattaactcatcagccaggtccatggccagttgttcgtccccgttggctaggtacaaggcgttcatagccacccggtcgatgtagttttccaggtagtattccttgtcgttggtccgcatggcgtattgggcgtaaaatttgtaggcggccataaaggagtggaagtggaagtcttgttcctttaagtattggtagagtcgatctaaaaaggcgggcgtatattggcgaataaagtcttcttcgaggtagtcgttttcgattaaccagtttagccgttccattacggaggagaacttcttggtgtttggttccacgttttccttaataaagtcgtctagggcttcttgatcgaggttcaactggatttgaccatccttggggatgttgatctcgttgtttaggtcgaagtacttcaccttggtcatatcaatttctgaaagagccattgatcacgttcctactttcttttatacctgagttaataacaataaaaagggcgggcacctagaacaggtgtcgccgcccgtaaaatttttgcagcgcccttaggccaaggctgaaaggcgatccggtcgaaaaccggtgaaggcgttaccgtcgggaagtttaacgacgggggttgccaaaaagccttctgcctttaagttttcgatgaattcaggttgttcatcgatgttgtgttcaatgaacgctacattgtgttcctctaagaaacgcttggtcattttgcattgaatgcaattattcttggaaaagacggttaccatgagcatttcctcccttaccaatatttgatgttttctagtatagccgatcaatcataaaaagaccaccatatctcgtgctggtcgaaaacaataacacaagatatggtggttgatgggacgtggttaggaccgaatcaaaaaaagttgaaaaatttttagccgatgattgaacagtcatatcgacagatttgaaagtaactaagagcatattgtacactgaagagcgataaaaaactagccaaaaggggggcaaagaatggaagaaaaaataacggagcgtggttatatgaaggaggccttcaaggaggctaaccaagcggccttgctgggcgaagttccaattggggcggtcgtcgtttataaggggaaaattatcggacgaggacacaacatgcgggaaaaattccaagatgccacctaccacgccgaagtattagcaatcatggaggcctgccaagcgttgggttcgtggcgactagaagaatgtgatctttacgtcacccttgaaccgtgcatcatgtgttccggggcgatcatcaattcacggattaaacgagtcttttttgcggccccggatgaaaaggcgggggcggtatcctccctttaccacctattagaagatacccgcttgaaccatcaagttgaagttcaccagggcctaatgcaagaagaagccagtcaaatgctcaaggagttctttcgggcgatccgtaagcggcaaaagacggcgaagaaaaaacggctccaggaagaaaatgcggctcaaaaggctggtcagtgaccgaaaaatagtgtatgattgtttttgccgttaggccttagggcaagggcgtccttacgaaccgtgtcaggcctggaagggagcagcactaagtttgcgattccttgtgccctaagtttgaatgaaattaaccaggaggctgggagaaacattgttttctcccagcctctttgaattttgagatatctcttttggtagatgattaaaagctagtataatggataaagatatcttcaaaagcagggaggaacagagatgagttatcaggcgctctaccgggtttggcgaccccagcggtttagtgacctcgttggtcagcagatcgtttcgaccaccttaaaaaacgccatcatcaccaaaaaaattagtcacgcctacctctttgccggtccacggggaacggggaagacatcggcggcgaaaatttttgccaaggcggtaaactgccaccaccaaacggatggggaaccctgcaacgagtgcgaactctgccaatcaatcacggcggggcaactaaatgacgtaattgaaatcgacgccgcttccaataacggggttgagcagatccgtgacattagagataaggtcaagtacgcccccactcaggctgactataaggtttatatcattgacgaagtccacatgttatcgaccggggccttcaacgccctcttgaaaaccttggaggaaccgccagccaacgtgatctttattttggctactacggaaccgcacaagatccctctgacgatcatttcccgggttcagcgctttgattttagacgaattagcgcaaaggacgcctttgagcggatgaaatacatcctggatcaaaaaaaggtcgcctaccaagaggacgccctatgggtgattgccaacgccgctgagggggggatgcgggacgccttaagtattctcgaccaggcactgtcctttggcgatgagcaggtgaccattgatgacgccttattggtgaccgggagtgtgaccaagcagctggtgcaggaatatttcctgcaagtagccaagggtgatagcgccccggccttagagacccttactaagatcaccggggcgggcaaggacggtcagcgtttcattgaggacctgatctcctttattcgcgacgtcctcttgtaccaggaatcaccaagtttgattgacctaccggcgacgggcctgcgtaaggaagattttgatcaactgagcggcgccgcaagttcgacggctctgtatcaaatgatcgataccctaaacgatatccaacaggagatgcgctttacgacgcacccggacgtctacctagaagtgttaaccgtccggttgtgccagattagaggggacgaaaggacccagccaggtgctgaccaagcggaacttacgcagcttcgccaggcggtagctgccctacaacaagaggttaatcagctacgccaaaccccaccagcagaggtgaaaacaccggcgccaaggccgagccggtcgactagcaataaacaggcgttgcggattaacttagcccaggttaacttgatcttgaccaacgcaacccggcctgagttagagaatttacagggcctgtggggagacatgctttccttattagataacgctcagagctcgttgatcaataattctgagccggtggctgccagtccggcgggggtcgtggtatcctttgataataacttcctctttgaacaggccaacgggggcaacctaggtaacgcaatgggggcggccctacaacagttgaccggtagcgaacgccaagtggtcttcgtgcctaaggacaagtggccccaaatacgccaagacttcttagtggaaaatggttacttaaaaaagggaaccgctaaaaaggaggcccccaaggcaactgatccggtagtcagtcaggccgaaaagttgtttggcccggacgcaattgaagtaaaaaacgattaacaataaaggatggtaatgaattatgatgcgcggaatgaacatgcaaaagatgatgaagcaagcccaaaaaatgcaaaagcaaatgatggccgaacaagaagaattagcggccatggaatttgttggccaagcgccggacgaaatggtaacggcgactttaaccggggacaagaagctcaaggatttgaagattaacccagaggcggtggacccagatgacgtggatatgttaagcgacttaatcgtagcggcggttaacgatggcttagacaaggttgaacaggccacccaagctaagatgggcaagtacacccgcgggttaggaatgtaaggtttaggtgagcaaatgcagtacccagaaccgattgcccgtttaatcgatagctacatgaagctgccgggaatcggggagaaatctgccacccggctcgccttttataccttgggcatgtccgatgcggacgtggataactttgccaagtcgttaagggccgttaagcgcgacttgcactactgcagcgtgtgcgggaacattaccgaagacgacccgtgtcccatttgtaaggataagacccgtgaccaaagccgggtcttggtggtggaacggtccagagacattatggccatggaacggatgaaggaataccacggcctttaccacgtcttacacgggacgatatcgccaagcgaagggacgggcccccaagacattaacttggagagcctcttaaagcgccttgaagcgcataaggaaatccaagaggtgatcgtggccaccaacgcttctttagacggggaaaccaccgcccagtacttggcccacttgattaagccagccgggatcaaagtaacccgcttagcccatggtttatcagcgggggcggacattgattacactgatgaagtgaccctcttccgggcggttcaagggcgaacggagatgtaagatgtttttcaaacgaccacaacatcaagttgaacaggaaggtaaccaacgcttgttaaacttgatttaccaaaccaaggccagctgggatcacgcaaaggaaacggagcaagccgtttacgaaagccatgttaataacgagctcaaggagcgaactaagctgcaagagcgcaagtacttatacttgtacgaacgggcacgtaagcgaggcttgcacggtaagaccaacgctggtgtaattatgcaataagataggggcgcaccaagagatgagcggacgatttattagttttgaggggccagacggggccgggaagacaagtgtcttaaccgcgatccggacgggcctagttaaccagttgggtgatcaagttgtctatacccgtgaacccgggggaaacccaatcgccgaacaagtacgggcggtcttgttagataagcaaaacggggcgatggatgactggacggaggccttattatacgcggcttcccggcgccaacacgtggttgaaacccttaaaccggcacttgaagcggggaagctaattttgtgcgaccgctacttggatagttcaattgcctaccagggtgggggacgtgagttagggatcgaccgaatctgggagttaaaccagtacgccattgacggtctcttgccggacctaaccatttttttggacctccccgtggaaaccgggttagcccggattgaaaagggacgggcggagacaattaaccgcttggatgagcaaaccaccaacttccaccggcgggtccgtcaggcctacttaaccctggccgagcgcttcccagaacgaattgtgaaggtaaacgccgatcaggaattagcgcgggtaattgaagacgtacgaagcgcaattcacgcacgttacgcagacctatttaccaactaaggaggaaccgtcatgaagatgattatggccattgtgcaaccaaaagacagcaaccgccttcgcgacgcctttaacgacgccaagattggcgccaccaaactttcgagtaccgggggctttttgcgggaagggaacacgacctttttgattggggtcgccgacgatcgtgttgacgatgtcttagagatcatcaagaaaaacgccgagtcccgggagcaatacatgacgccgcctacccacatggataacggggcgggcgccatgccaattaacgtgcaagtcgggggcgcgaccgtcttcgtcttaccggttgagcagttcttacacttctaggacggagggaagagaacatggagcgtgagctaaccgctatcgcactacaacctgaaatcacggcgcgctttgccagcctgattgagcgggggacgctggctcacgcctacctcctagtgggcaacgtcaacatgggaacggtcgcgttagcaacggaggtcgcattacgcttgttttgcccccatcaagacgaccaggggcatcccgatcggacgtgcccagagtgccagcgggttctttcggggaaccacccggacgtggtggtcgcccgtcccgaggggcgtcagattaaggttgatcaggtccgctatctaaaggccgaattttccaaaaccggggttgaaggggagaaaaaggtgttcatcatcgagggggccgaaaccttaaccggctcggctgctaactccttattgaaatttatcgaagaacccgggccgggggtctacatctttttgttaactcctaacaaaaatgccgttttgcagacggttcaatcccggtgccaagtaatcgaattacgccccttgccaagtgaaatggttaaagagcagctgcaagaggcgggggtaccagaatacctgggccccctggccgcggggctgggactaagcgccaagcagggggcctctttgatggaagacgactggctccccaccagcgtgaaactagtttttgactggtttaaggaggtagctagtggcgatccgctcagctttgtggacgtccaaactggttttttaaagcagggtagcgaccgggcaaagcaactagtcttgttggacctagtgacgatggtttggcgcgacgccctcttgttaaagaaccgggtgaccgaaccagagcggcttcactttcgtcagtggcaagcagaagtgggccaactgatcatgccaagttcggcccagcaagttctcgtggccagtgaactaaccttagaggggcgccacttgcttgatcaaaacataagctttcaaaacgtggtggagcaattaacgctccgcctcctcttggtgatgaagggtgactttagtgaggaaaggggcagcaaccgtgagtgaacaccttgataagggcaacctgtatgatcgcttgaaccaggccattcagcagaccagggaactagtggttagcatggaggggttgcaaaagatgatgacgcaggtattagaagaaaacgccgccttgtcaattgaaaatgaccacctaaggcgcctattggaatcacagagccaaaaggatgccggtgggctgacggcttcacaaaagaagctccaaaagatctacgaggagggctttcacatctgtcacgaatactacggaaagcgtcgcgatgatgagtgcctcttttgtcaatcggcgttaaacccgcgtaagaaaggaaaatagggatgcaaagacaggcaagttttcaagcaaccgaaacggggcggctgtacttagtacccactcccattggtaacttagacgacatgaccttccgggcgattaaggtgctaaaagaggttgacctgatttgtgccgaggatacccgccacacccggcagctactaaaccactttgagattaccaccaaggcgattagctttcacgaacacaacactgaacagcggctgccagagctggtggcccgcttaaagcaaggggaaaacttggcccagtgcagtgacgctgggatgccatcgatttcagaccccggcaaggagctagtggcggcctgcgttaaagaagggattccggtggtccccctccccggggccaacgccgcgctcaccgctttgattgcttcaggactttccccccagcccttctacttttacggtttcttggagcgcaagcaccagcaacaggtgacagaattaacggccttaaggaaccggggcgaaacgatgattttttacgaggcgccccaccggttggctaaaaccttaaccacgatggcggaggtttttggagaggagcgccaagccgttttggcccgggaattgaccaagcgctacgaagagtttgagcggggcagcctagcggaactcgtggcgtgggcaaaagaaggggtccggggcgagtttgtggtgatggtggccggcaatgaccacccccaagaagatgaacaacgcccctcgggaacgcccttagaacaaattcaatccgccgtggatggcggtcaaagtcctaacgccgcgattaagcaagtcgccaaacggctcggcttaaaccgtcaggacttgtataagcagtaccaccaattataggaaggatcgaacgagcaggatggcaacggaatttgaaatgtaccaccacgttaagtactacgaatgtgacaccagtggtcaccccaccctggccatgatcgtcgcaatgctgatcctcgcttccgaagccgataacaaggaaaacggggtcggcctaaagcgggcgggccagtacggtggtggctgggtgatcatcaactacgaaggaaccctagctgaaaagcaaccggtgaaggatgaagaggtaatcttagggactcgggtccgggcgtacaaccgcttctttgtgattcgtgacttttgggtcaaggatttagcgggcaactactacgctaaggtgagtgggacctttgtcttcatgaacctggccaagcgtaagattatgacgattccccaggagatgattgataccttccagatggacgaaaccaagcgcttgccacgcctggaaaaacccagcctgccagaagaccaaaccggctgggcgaaacgggactaccgggttcgttactttgacatcgatggtaaccaacacgtcaataacgcccactactttgagtggatgatggacgtcttggacggcgactttttgcgcacccaccaggtagttaagatgcagaccgagtttgcccacgaagttcgctacgggcaaacggttacgagcaccgggtcgaccccggttgaaaaagaggggctaatggtgacccatcaccaaatcacctgccaaggacaagagagcgcccgggcgaccttttactggcagccacggaattaaatgaaacgggatcagaccttacgggagtcggaaacgactttgggggctgatcccgtttttgatcaacagaaaagtaataatcgtgctatcctaaaggaagaacttaattatgatggggagtggtgaacgtggcaaagcaacggtacggtgggatcatgtttttggagcccgatcaagtgggactccggatcattgatcgccaggagaaacgaccggtgacaaccgtcgaatcggggaacctaaacgtggggactagcatggtggccaactatgccgaaaatatggatgcgattgtcgacaacctgattgggtttcaacgggtcctcaaggagtaccaagtagacgaggtggaattttacggggccctagaggacctagatgaggtaacggcccgttacgtggccgatcaattaagcgtccgctgtgggctggaagttaactggcttagtgacaaccagcttatcgctcggaccttagttgcaattaagcatcagcacaaacgtcaaggaatcaaagaaggggcggacacctttgttttgttagtgggactatcgactagtaccctcgcttactttaaaaagggcgtctttgagacctcttggaacatcgacttagggaaggccaaaatcagtcaactcgccgagaacctacggcagaccacggccacgccgagtgacatcatattcgactacattagtagcaaggtcgaatacctagtgggggaactgggcgacgttgaaaacgccacgctgatcgtccagggggtctcggtgttagcggacgcctacttggagcgtgggcaattcctaggggaagtggccttggatgactttgacaccagctaccgacggattaccgactcgaccgaccagtacgttatcaaccactaccaagtggatgaacaaagcgtgggttgggtgttaccaagctttttaatcatctcccaaacgttgcggctcctacacgctaagcagctttacgtaactggggtgaccccctttgaaggcttaatcgccgtccgtgaagggcaggaatcccaaattagccagatgattcggacgtcggcggacaacattgcccgtcgctacggggtcaaattggcccaccgcgcttttgtaaccaaggtgaccttggaactgtttgacgctctcgccccgatccaccgcttggacgagcactaccgcttgttagttgagatcgccagcaaggttgatgacatcggtaacttcatcagcccccaggggcactaccggcactccgcttacattttagaggccaaccccctgatcggcctttcggatcaagataaccgggtgattgcggaggtttctcgctaccactcgtcggaaagcccggacgttgatgaacaccactaccggaacatggatgacgaaattcagctaccggtggccaagttggcggctattttacgggtggccgattcgctagacgactcccgccagcaaaagattagtaagttagaactcgctttggaaggcaaccgcctcttgatttatgcccacgctagcgatgacttggtgctagaaaagtgggccttccaacgtaaaaataagttattcaccgacgtttatggtttgcaaccggagttaattgcaaagggggacaactaaatggactacagggatttttaccaaccagaaaattacgtgaaccgggaactatcctggattgactttaacgggcgggtgttagaagaagccgccagcccaaccaaccccctgttggaacgggccaattttttggggattacccaaagtaacgtcgatgaattcttcatggtgcgggtggcttctttgagtaagttagccgccgctggggtaacgacaacggacgcctccgggatgaccccggcagcacaactgacggcggtcaacgaaaaggagcaccagatggtggcccggcgctaccaggtgtataaggacgtcttacttccggccttggaagctaaagacatccacctggtagccgttaaggacttggatcaacaccaacacgactacttgcagcgttactttaacgatgaattattaccggtcctaaccccgatggccgacgactcatcgcggcccttcccctttatctctaataactccttaaacgtggccgttaagctgattcgtacggctccggcaacgaccgctaaggaagtgctcgagggcgatcaggaagtggtgaccaccatttcccagccccacgaaaaaaaggaacaagacggtaagtacgaagaggaattcgccaccgtccgggttcccgaggtctataagcggttggttaagatgccgtcatccaacacctttgtcctcttagacgacgtgatcaagacctttatcagcgtcctcttcccgggctacgccgtgcaagcaactggtacttaccgggtcgtgcgggacatggacctggacgtggccgaagaagacacctccgacttgttgcgggcggttcagcaccagttgcgggaacgcgagcacggtcacgttattcgcctagaagtggagcaggggatggacgattggctggcggcccacctgattgataaccttaaggtcggcgaagaaggggtttaccgcattgcgggcccgattgacttaacctttttaaagaagctctccggcatggtttccgaccacgaagaagaccgctacagcaagtttaccccgtacctagccccggaattggatatggaacacaacttatttgacgccattcgggaaaaggaccacctgatgcaacacccctacgatgatttccaagccgtcgttaactttattcaccaggcggccaccgaccccaagaccctagcgatcaagatgaccctctaccgggtatccggaaattctccaatcatcaagtacttggggatggcagcccagcagggcaaacaggtaacggtgctggtggaagttaaggcccggttcgatgaacaaaacaacgttcactgggctcgtcggctagagcggatgggttgccacgtaatttacgggttagtggggctcaagacccactgtaagctcgccttggtcattcgccgcgatgaagacggaattcgccgctacatgcacctgggaaccgggaattacaatgacgtgaccgccaacttctacaccgatatggggttgtttacctgtgattacgaactcggggtcgacttaaccaacctctttaacatgctgtccggtttcgcccggccacggtatttccacaagttgcgggtttcaccgggtggaattcgcaacttcattaacgaaaagatcgatgaacaaattgaggtggccaacaagggactgccggccaagatccggatgaaaatgaattccctgtcggataaacaaattatcgcccacctatacgctgctgctgcggccggggtgaaggtggagctattgatccgggggattacgtgcctgagaaacgatttaccgtttttacacggtaacatcacggtccactcaattatcgggcgctttttggaacactcgcggatttactactttgaggccaacgggcactcggagatctacttagcctcggccgacatgatgaccagaaaccttaaccgtcgggttgaagagctcttcccggtcacccaagaagataccaaggcacgggcgatcgaaatttttgatacaatgtggcaagacgacgtcaagacccgggttctaaagggcgaccggtacaccccgctgccgttcagcggtcaggtcgattgccaagagatcttcgttgatcaggttaaacaacaagaacgagggcagcgccaagaacaaaagaaccggcgccacttaaacaacgtctttgaaacccttagtcgtcacgtcaataacctacgcctcaagaagtaaaagggggaggaaaatgtcaaccaacttaaaggtgattgatttgggatctaactcggtgcgtctgcggatcaccaaaattttagatgatggccaaacggaactactgcgctacgaaaaagagtacgtgcgcctgtcagaaaacatgggtccggagcggacgctaaaagaggagcctatggccaggaccctgaaggcgttaaaggactttaaggagatttacgaccagtttgacggtgagatcatcgccgtggccaccgccgccgttcgccaagctaccaaccaacgggactttctggagcgcgttgaacaagaggtgggcctgacgattcaagtgatctccggcaaacgggaggcctaccttgattacctaggggtttcccggaccctaccactggaaaacgggatcatcattgataccggtggggcctcaatggaactaatcttagttgaccagggccaggccgaggagacggtttccttgccgatcggttcggtcctgttgtcccaacgttaccaccttggcgaccaagtaagcgccgccaacctgtacgacgccgtaatcaaagtcgatgaggttctctctagtcaacgctggttgagtcgggcccgccacacccgggtggtggcccttgggggctctaaccgggccttagctaagatgtaccggtggcgcctatcggacgggaaggacgttcccttgccggtccacgggttaaccatgcagacggttgacgcctacgaaatgatggacgacctgctgcggatggaccgggagcagcggggcaaggtacggggggtatcgacggcccgggccgacgtgattatcggggggctgttgccgatcatggccctcttacgccagttaaatatgaagcaagtgatgttttctagcaacgggctacgggaggggctcttgtttgaatacattgaccaaaagtttgggggctttcgtaccgaccgggcttaattaaagattgaaagcgctttttatcgacgagtgtggtacaatctggttgtagtaaaagttttagtaaaaatcgaaaggatggtaacagcatggcaatcttagtcgctggtggggcgggatacattggttcccacatggtaaaggacttactcgcaaacggggaggaggttgtggttgccgataacctctcaaccggtcaccgcaaggctgtggacccgcgggccaagttctacattggtgacattcgcgaccgggcctttttagaccaaattttcattaacgaagacatcaaggcggtggtccactttgccgccttctccatcgtgccggaatcaatgagtgaacccctcaagtactttgataacaatacggggggcatgatcaccctgctcgaggcaatgcgcgactttaaggttaaatacattgtcttctcctcaacggcggccacttacggggtgccggaacacatgccgattaaggaaaccgatccacaaaagccgatcaacccatacggtctgtccaagctaatgatggaacacatgatggcttgggccgattcggcttacggggttaagtttgtcgccctgcgttacttcaacgtggccggggcagcgccggatggttcgattggtgaagaccacggcccagaaacccacctggttcctatcatcatgcaagtcgcccagggcaagcgcgctgaactgtccatctttggtgatgattacaacaccccggatggtaccaacgtccgtgactacgttcacgtaatggatctggctgacgcccacctcctagcacttaagtacctctttgccgggaatgaatccaacgcctttaacctcggttcttcgaccggcttttccaacaagcaaatgctagaagcggcccgggaagtcactggcaaaccaatcccggctaagatggccccacgccgcccgggagatccggattcgttagtggccgcctctgacaaggcccgcaacgtcttaggttggaagcccaagtacgatgacgttcacgacatcattgccaccgcttggaagtggcacgaaagccacccccaaggctacaacgatcgtaactaaataaagggaccactgcagtcctgaaaccaaagaggcaaggagaaaaccgtgttttctccttgcctcttgccgtatattcgaatgttcaacggaaaacgtgggaaatagccgcaggcctagtttctaagcaggccgaagaacggtgcgtgccgcaccaaaccgttcgtccgatcttaccctgcatcgaaggttatttcccactttcctcctacgcttagtcaacttcctggtcgcgggcggattcttggagcaaaccgtcgaagaagcgttggattgacacctggccccgccggacgtcttggtggtggaggcgctggatctccacgtggatattttggtactcaaagaggttgttggcgtactcgagtaggatatcattttccgggtagtcgatgcacatggtggccaggttggtgatccccacccgcagggcccgccggattcgttggtaggcgatctttttttcgtggtcatcagcgtggaagtcgcgctggaaatcaatggaagaaaagctggccttttgatcgatcatcacccggatgatcttacggatatcctcactccccgtctcggaggcaatccctaagaagcgcaggacggtgtccacgtgatccatttggcggcgttgggcagcctggggtcggttatacggggcgattgaagaggaggaaatttcgtaaatccggttgacccggttgagtaagcggacgtgagtggcgacctggcgaatgatgtggcgcgcttcggtgtggttgagggggtgaggaaggtaaaagtcacagccagcccggtaggcggcctccttagcggcgggggtcggtggccccaccatgatgaagtgggggtggttgttgacttgttggaggcggtagattagctcaatcccgtccatcccgtgaggttggtaggggaggatcatgatgtcgacccgtagttggaggagttcttcgtaggcccggttgggatcggcggttaagccgaccagggtgttgtcgaagtcgttttcaattaggtcacggagaagggcactagtggcctggtcgtcttgaagaaggtagaagttcacgggttagctcctttcgcacggtggttgaaggtgattgaaggggtgcgccccctttttaacgttagaataaaagcggttactatttaataaatagtactttttatgacttttagcaatagattgtactaaattaattgatttaatggcgtgattaaggtgatgacaactaaactagggggaggttaggaggcgccgctcgttggaccatttttgaattaagctgaagtagtgcgaagttttttgaaacccgattaagttgtttttttgctcaccaaaagggaataggaagtgggtaaaaaacgcccgtccgttgaatataaacatccaatatacaaaaacttgagtttccattcacaaccacagaggtggaaaaagaaaatcgttcggatttggtgatgattccgggcgctttgcgatggtccttgaaaacgcttgctatactaaaaattgtaaagagaacactgatagattaaaggagggcccgaaaatggcttttaacttacgtaaccgcagtttcttaactttggctgactttaacactcgtgaaatggaatacatgctcgacctcgctgaggatttgaagaaggctaagtacgccgggacggaacaacaacacttaaagggtaagaacatcgctttaatctttgaaaagagctccacgcggacccgttgctcttttgaagtgggggctaaggatcaaggggcgcacgttacctacctcggcccatctggttcccacatcggccacaaggaatccgttaaggacaccgcacgggtactcggggggatgttcgacgggatcgaataccgtggtttctcccaacgtaacgttgaaattttggccgaatactccggggtaccggtttggaacgggttaactaacgaagaccaccccactcaagtcttggccgactttttgaccgctcacgaagtactgaagaagccataccaacaaatcaagtttgcctttgttggtgacggccgcgacaatgtttccaacgccctgatgttaggggcggccgtaatggggatggaataccacgtggtcacgccaaaggaacttgaaccagaagccgaaaccttggcaaaggctaacgaaatcgccgctaagaccggggctaagattgtcgtaactaacgacgttaaggccggggttaagggcatggacgtaatctacgccgacgtatgggtttccatgggtgaatccgacgacatgtgggcaaagcggattgaactgcttaagccgtaccaagttaccaaggaagtcatggaagcaaccgaaaacccgaaggcgatcttcgaacactgcttacctgccttccacaacacggaaacggaagtcggcaaggaaatcgctgaaaagtttggcctgacggaaatggaagttaccgacgaagtctttgaaagtgaacaatcggtggtcttccgtgaagccgaaaaccggatgcatacgatcaaggccgtaatggtagcaaccttaggggactaaagaggaggaactggcatggcaaaagtcgtcgttgctttaggggggaatgccttgggtaaatcccccgaagaacaactgaagttagttaaaaataccgcttcctcgttaattggactgatccaagccgggaaccaggtggtgatcagccacgggaacgggccgcaagttggtcaaattaacctcgggatggattttgccgctcaaaacggtaagaccgcggcgtttccgttcccagagtgtggggcgatgagccagggctacattggttatcacctgcaacaaagtttgcaaaatgaactccaccagcgtggaatggaaaaagacgttgtgacgacggttacccaagtggtagtggaccctagtgacccggcctttgaaaacccaactaagccagtcggtgacttctacaccaaggaacaagccgcccagatcgaacaagagaagggctacacctttgtcgaagacgctggtcgtggttaccgtcaggtagtgccatccccgctaccaaagcggatcgtggagttaaacagcattgaaaccttaattgaaaacgggaccttggtcattgccgctggtggtggcggggtgccggtggtcgaagaagacggcgccctgaccggagtgccggccgtcatcgataaggaccgctctagtgccctcttggcggataacgttgacgccgaccagctgatcattttaacggcggttgactacgtttacatcaactacaaccagccggacgaacagaagctgaccgaattaagtcaagcacaggcccaggaactgatcgatgccggtcaattcccggctggttcaatgctaccaaagatccaagcttgcctgtcctttgtgaagggccacccagaacgcaaggcgatcatcacctcactcgccggcttagaccaggccctagaaggcaagttaggaacggtgattcacggttaatcaccacccgcttaataaaagaagctggaaacgaagactagataaggagtgcaagaaacaatgacaagtccaattcatgtgacctccgaaattggaaagctcaagacggtgatgcttcaccgaccgggacgtgaaattgaaaacattacgcccgactacatggagcgcctcctctttgatgacattccgtacttaccaattgcccaagaagaacacgacttttttgcccaaaccttacgggaccaggggattgaagtgctgtactttgaaaagttagccgctgaagcattggcaagtgacgacgtcagaaaggaatttttaaaccggatgatcgccgaatctggttacgttgcgggtaccacccacgacgccttatatgactacctctaccaaatgaccccgcaggaaatggttgacaagatcatcgaaggggtgcgggggactgacattgacatcgcccaaccggatctgcaatccgtttccgaaaatacggactggccgttcttaatggacccaatgccaaacgcttacttcacgcgggatccgcaggcctccattggtgacgggatctccattaacaagatgactttcccggcccgtcaacgtgaatccctgatcacggaatacatcatcaaccaccacccacggtttgcggggcaagttgaggtatggcgcgaccggaaccacgaatcccacatcgaagggggcgacgagctcgtcttgtccgaccacgtcttagcaattggggtttcccaacggacgacggcggacgccatcgaagacatcgctagaaacctctttaaggattctaactacgacaccgtgattgccatttcgatcccacataaccacgctatgatgcacttggacacggtcttcacgatgatcaaccacgatcagtttaccgttcacccggcgatcctagatgacaagggtgaggttgacaactgggtcttgcacccgggcaaggatggtgaaattaccatcgagcaccatactgacattaaggcggtcctcaagcaggccttaaacaagccggaaattgacctgattccaaccgggaatggtgacccaatcgtggccccacgggaacaatggaacgacggctccaacacgttagcgattgcaccgggtgaagtggtaacttacaaccgtaactacgtttcaaacgccctgcttaaagaacacgggatcttagttcacgaggttcgctccagtgaactatcccggggtcggggtggcccacggtgcatgtcttgcccaatcgtacgtgaggacctctaagataacgaaaattagtaacgcattgaaccaaagaaggtggaggtgagtagtggtcagttcaataccacgggctcacttgcaccttttttgcgggttgaggaaaaaaggaggaaaatcaagatggaaaacaaaaacggaattgggcgcattggtctgattgccctgatcgtcagttcctgtatcgggacggggatctttgggatcaccaatgcggtggccgccgcggcggcacctgggcccgccctactagcatggctcttcgtcggttttggctttttgatgctcgtttttgcgcttaacaacctatcggaaaaacggccggacctggaagcgggtatcttctcatatgccggcgccggctttgggccgatgggggaatttatttccggttgggcctactggttgtcagcttggttgggtaacattgcctttgccaccatgctgatgagtgccttggggacctttttcccggtctttagcaacgggcagaacctaacgtcgatcatcgtggccattatcttctgttgggttttgaccctcctcgttaacagcggggtggaaacggcgacctttattaacacgattgggaccttctttaagatcattccactggtattattcatcattatttcgattatcttctttaaggccggtatgtttacgaccgacttctggggccacgtcgctaacaacctttccaaggggacggaaacgggctcggtatacacccagatgaaggggaccctgctgacactgatctgggtcttcattggggttgaaggggcctccgtcatgggtcaccgggccaaggaccggacccaagcccaacaggcgacgatcatcgggttcatcctcttgttgatcatttacgtgatgatttcgattattccttacgggaccctgacccgggcccaactggccgccgctagtcaaccagccctggggaacgacttgaagttgatcgttggttcctggggggccacgattatcaacgtcggcttaattgtttcggtaattatttcctggctttcctggacgatgctgccagccgaaacgacgatgctagttgccgaagacaaggcaatgccaaaggtgtggggtaaactcaacgctaagaaggccccaacggcctcgctgatgatcaccggggttttgcaaacgatcttcctgttctccttactcttcactgaacaagcctacaactttgcttactcactggcctccgccgccatcctcttctcctacctttttgtggggctgtaccaaatgaagtacagtcaagaacaccaagagtggggacagtggacgattggactcttgttggttctcttccaaattgcctgcatgttcttggccggttggcaacaagtgctcctggtttcgattagctttattccgggctttatcatctactaccaaggggtacgtgaaaataaccggacgatgagcgggggcgaaaagggaacgatggttgtagtcttagcctttagtttaattgccatcttcctgatctttaacggaacgattgccgttgggtagaaaagaggtggcaaacaacttgctcggccgtacttaggcgctaggtctgcggttgttaaccacgttagcgatgtagcgtttagaaaacataaaagccacccgttaccgattaggtagcaggtggcttttgtgttcagggggtgacacgcgttagccccaaaccgcgtccgcaatctccttaatgagcttaagcttggcccattgttgctcttcggttaagatattgccttcttccgtggaggcaaacccgcactggggacttaaggctaggttagctagtggaacttctttagcggcttcgtggatccgggcgatgacttggtcggggtcttctagttgaccgtccttagaggtgattagccccaagacgatggtgacctggtcgcgctgattgaggatcttcttgagcggggcaaagttaccgtcgcgttcttcgctgtcgtattccaagaagaagccgtcgtaattgagctggcccaggtattcagcgaccagttcgtacccaccggaaaagaggaaggtcgatttgaagttcccccggcaaatgtgggtggtaattgttaggtcggccggcttgtcttttaaggctccgttaattacggtgacggcgtcttggcacagttggacgtacttttggtgttctccaggttggtccttagtttcgttgagcttactgattaaaaaggcccaggtggtgtcgtcaatttgcaggtaacggcagccgagttcgtaaaagcggtggatcgtttgtcgataggccgttgccaggtcagttaagtagtcttggtagcggtcgtaaaagtccggccagtggtcggaacggttatcccggaagagcatcgttggtgacgggatcgtttgcttagctaagacgtccgggccggcctgctggttggtaaattggaagtgcttgaagaaggggtggtcagggttgtaggccaccttgccgaccagttcggcgttgtcggtacgggttttggcacccttaaaccggtagctttggtggtagttgtagtgaccaaccccggtcagccccacaagaagtccaggtgccaccagctccgccgaaattcaccatcggtcacggcgtgcaggccgaccgccttttccttttcaattaaatcggtgatacaggcgtcttccacggcggttaaaccggcttgatccagttcgccctgcttgaattgctcccgggcttccttgagcttttggggacgcaaaaaggagccgacgatgtcatttttaaagggcgcggttaaagttgtggtcataattaaacatcctttctatctgaacaatggtgtgggaactaaaaaacgtccctagaaaagaccattgtcttctctagggacacattcaagttatcttaaaagcgtgttaccaccctaattcggttctccctcacggcaaaaccctcacgaggtacatccaaacggagatacccggggtgataacgggcccaaccgccaccagttaatgaattcactggtcgaacttgctcccagaccatcttcactagttagccaccccgtggttctcagctcccccacatctctgggtgggggccaaccagttactcatctgttctcagcaacttatcatttaattttcatcattctaagccagggggtggtaaaatgcaagcactaaatttaatccgggcgccccttgttaaacccggtgaaggcgcgctaagattaaatgaaaatggttttaatagaaagggtgggacagatggttgaattagcaccgtttggcgtcgaagcttggttaaataaatgggaaaaaaaggcccgctacgatatttcacaaagcacaattgcctccttatcgatggcggacctacgggagttggacgatgatcccaataccctagacaaattactctttgacgctaagcttaattacggtttgattgaaggttcaccagcctttaaagaggcggtagcgcaactgtacgagcacgtcgaccccgaccaggttctgcaaactaacggggccactggtgctaacctagccgtcctctacgcactggttgagcccggagatcaagtgattgcggagtacccttcttaccaacagttatttgacattccacgctcgctaggagcgacggttgattactggcgcctacgcgaagaggaagggtggcagccgcggttggctgagttagctaacttggtcaccgaaaaaaccaagctcatttgcttaaataacgctaataaccccactggtacggtactagacagggagacgttaagtcgggtagctgagattgcccgtgaagtaggggcttacgttttggttgacgaggtttaccacccactaatgaaaaacgggacggcttgttcgatcgtcgacctctacgaacgggggattgcgaccgattccctgtcaaagacctactcggtaccgggactgcggattggctggacggtgacgaaccgggaagtggccgaccgtttgcgaagcgtccgggactacaccatgatttgtggtggggtggtcaacgacctgttagccacctacgtcttaaaccatcgtcaccaggttttggcgcgcaaccgggcgttggtggaacaaaactgggccctgtatcaagactggctggccaaggagccgctggtttccctagtggccccggccggggtctcaacctcctttccccgcctgttaattgaagaagacacggttagtttttgtacccggttactggaacaaacgggcgtcttgttggttcccggggaggctttcgaaacgccccaccacgttcgtttaggctactgcgctccccaaccggttttaaaggaagggttacgccggttaagcacctttttacacgcccaaaactaaggcgaataggatggacaattgctggtggggcgagtatcgtgggtatgttagaaaaaagtagaagggatcgatggaattgaaaattttggcgattgacacctcgaatcacccgatgagtattgccctggtggaagacgaccgcctcatggcccaaacgaccctgaacatggtccgcaaccacagcgtttacgttttgccgaccattgaacggttaatggatgatttgggctggacaccagcggatttgaaccgggtggtggtggcaaacggtccgggttcgtacaccgggatccggattgccaccacgacggccaaggttttggccacgacgctggggatcgacttggtggctgaatcaagcctgaaggtcttggcgaccaacgttcttcccgatgacaagcgcttgatcgtcccctttttcgacgcccggcgtggcaacgtctttgccggtgggtaccagtaccaagcgggaaagttagtggcggtgatggaagatcagcactgcgcctttagcgacttaatggttagggtgacccaacagccacagggcgttttgttaattgggcaaagcacaccgaaactggccgacgagctggccaagttgcccactaacgtaactttagcgcctgccgatttaaccctgccgtcaacgtaccacctggccctgctgggaagaacggccaccccggtcgccgatccggatgccctggtgccagactacctgcgactcaccgaagccgaggcccagtggcaaaagcaacatcccggtcaaacggcccaggagtacgttcatgaagtttaacgacctattgcaccggctgatgactagggaagggggcaatccctcgctctgctttgcgacacggcgggtgataattgcgggggacccgtacattctgcgccaagcaacggtcgaagacgcccccaccttggtcgaaattgaacgggtcatctacggggaagccccgtggaacgcagtggccttcgtgggcgatattaaacggcccgaccgcctttacgtggtggtggaaactacgggtaaggtgatcgtagccttggtggggttgtcactgcactttcaccaacgggatggtcacatcaccaacattgccgtttccccagcttaccagggacggggaatggggacctatttaatgaaggcgatgatggccgtggccgtggctcacaagatgacgtcgatgagtctagaagtgcggattgaaaatcgaggcgcccaacacttgtaccgtcgcctgggctttgaggtgtgtcagcaaaaacaccattactacctgcccgacggtggtgacgcctacgaaatgaaaacgaagttaatgaggatgggggaacagcgagcaaatggtaaaacgaaacctgatcttggcctttgaatcgagttgtgatgaaaccagcgtggcggtgatcgaagatggtcaccgtgtgttatcaaacatcgtggcgacgcagattgctagtcaccaacgctttggtggggtggtgccggaagtggccagccgccaccacattgaacagattaccaagtgtaccaaggaggccctggagcaagccggagttagttatcaagacctaacggcggtggcggttacctatggcccggggttagtcggttcccttttgattggggtgacggccgctaagacgatcgcatgggcccaccaactaccgctcgtgccggtcaaccacatggccggtcacttgtacgcggcacggttcgtgagtgactttacctacccgatgcttgggttgttggtttccggtggtcacacggagctggtctacatgaaagaagagcacgattaccaaatcattggtgaaacccgcgatgacgccgctggtgaggcctacgataaggtgggccgggtgatggggatcaattatccggccgggaaaaccgtcgatcagtgggcagccaaggggcatgacaccttccactttccgcgggcgatggaaaaagaggataactttgatttctccttttctggccttaaatcggcctttatcaacacggttcataacgccgaccaacggggcgaagttctggataaatatgacctggcggcgagtttccagcagagtgtcgttgacgtcttagtcgccaaaaccattcgggcgttagatgaattcccggttaagcaactgatcttggccgggggggtcgccgctaatcaggggctcagaaagcagctaagcgccggtctacaagccaagcatcccgaggtgcaattacttcaggccccgctcaagtattgtggagataacgccgccatgatcggggcggccggctacgttaactacttacacggggatcgggccgatggttccttaaacgccgtgccaggcttgtcctttgcccacctgaaagaagaaaactaagggcaattaaggggccagggaaaaatcgtttttcccggccccttactgtagccacgaatgttagacagaaaacgtggtaaataaaagctggcgagcaccgtttcaaacggtgctcgccagcttttttaatagtgcctagtttacctctagtgagccatcgtggtaaacgacaacggttagggcaatgggattgggggcgccgttattaatcgctttttgggaggttgcttgcaggcggtaggcgtaaccatcgtagctgacgcactcccaggtccagtctccgccgttggtacctagtttgtgggaggccaccttgatggcggcctcctttgaaataacccgggggccgtgccaacggtgattgcccgtggaagcgaccgttatttgggtggtgggggaagccgaattagacgaagaagcggaggcgctagaaaaagtggctgacgatgattcggcgctccgttgcttagtgctggaacttgtgcctttggattcggagctggtggtttggctagtggtggtccggttggtggccgtggttaagccgtgccacccaattccgctgattagcccaatgatcaaaagggtgatcagcgaataggaaagtggttttttcattttaatcctcccaaatttcactttattctactctaggccccgtggggattcaattagggaaatcgtgaactttttgtgatggcaaaaacagtgaagaatactttgatagtcgaaacaaaaatgaaaaaatttagcgggtcgttttctagtgaaatgaataaaagttcatggataaccgatcgcgtcaaattggctctgaaacaagatagtttgaaggatcaaactattacctttgttggggtcgggagaattaaaaatgccgaagatggtttgacagtgcaaaagacattgaatataattccactatcgaatcttttgatactcgaaatacttttcgacaaggtaggtgacaaaattggcactgatgacagcgcaagaggtgatggatctgattccaaaccgctacccgatttgttacatcgacgcggttgacgaaatggaaccaggcaagtcgatcgtctgcacgaaaaacgtgacgatcaacgagtcattctttcggggtcacttcccgggcaacccggtgatgccaggggttttaattattgaaaccctggcccaggcggcttcggtcttgatcctcaagtcgcccgacttttataagaagacggcctacctgggccgggtccgcaaagcaaagtttcgcgggatggttcggccgggggacgtcttaaagctccacatcgacatggagaaggttcgctcgcgcatgggaattgtgaaggccgttgcgacggttgatgaccggcgggtttgcagcgcagagctgacctttatcgtggcggagcgagaggagaaactctaggagcaaattcgtttataatgtattttgatattcaaattatttgaattgctagaataacgagaggagaaatgcattatgaatgacgactaccgggaaatcaatcaggccttggtgcgggtttacaacgggatcatgtggattgaagaacatgaactcaggaaatccgccttctcggacttgaccatcaaggagatgcacgccattgatgcgatctcgatgtatgaccaccaaacggcctcgcaggtggccaaaaaactccacctgtcgccgggtaccatgaccgccaccactgaccgcctggttcgcaaggggtacgtgcaacggtttcgagacgagcataatcgccgggtaatccgcttgggcttaactaaacgggggcgggttttgtaccgctcccaccgggcctttcacaacatgatggtgaagagttttttgaaggggaccgatgaggaacaaaaacgggtgatccgccgttccttgatgaacctcgaggcctttttagatgaaaaatcctgattctagaagaaaggaaaatagccatgcggatacttgaaaccgcaagttacgttcccgcccgggtggtcactaacgatgagttgagccagttgatggacaccagcgacgaatggattaccacccgtacggggattaagcagcgtcacatcagccaaggagagaccacctctgacttggcggttaacgtagctaaccagcttttagcaaaggcggggctagccgcggaacaagtggccctgatcgtggtggccaccatgtcacccgacagttacaccccgtcaacggcggcaattgtccagggacaaattggggcaaccaaggcggtggcctttgacctgtcagcggcgtgttcgggctttgtttacgccctccacacggttgagcggttattaaaccctggtcagcgggccctagtgatcggtagcgaggtcttatccaagctgattgattggcaagaccgaaccacggcggttctgtttggcgacggggccggcggggtgctggtggaacaagaaactaccgggccctcccacgtgttgggtgagcacctagccacctttggcgaccaagccgaccaactgagtgccgggcaaacgacgccattaacgtccttcccgggaccggtaacgaaggtcgctccctttacgatgaacgggcgggccgtttaccggtttgccactcatgaggtgcccacttcaattcggttggcagcccaacaggccggggtaaccattggagatattgacgccttcttgttgcaccaagccaacgcccggattatcgatcaagtggcgaagcgtttgcaactggatcgccaacggtttcccgttaacatcagcgaatacgggaacacgtcggcggccagcgagccaattttatttgccgaagaagttcaaaaaggtcacctacgtcggggcgacctggtggccctaagcggtttcggcggtggactgaccgttggaaccctaatcttaagatactaaattaaaattaaagtgaggaaaatttaccatgactaaggaagaagtatttgaaactgttaagaacgttgttgttgaagaattggacgttgacgaagaccaagtaaccttggacgctaagatcaaggacgacctggaagccgacagcctggacgtgtttgaaatcatgaacgaactggaagacaagttcgacatccaattagacgttgaagaagggatcgaaacgatcggcgacgtggttgactttgttaagaagcaactggacgaaaaggacgcctaatgcaaatcggggttctttttagcgggcagggcgcccagaaacctgggatgggggtcgactttttgggcgaccccctcttttgtcaattggtagaagaagcgagtcaagccaccggtctcgatatcgccaccctgatgaagggtgaggggggcgaacttgattacaccaagtacgttcaaccagccctggtgacggtttcttacgggatttaccggatgttggaacgcgacctgcagttaccgattgccgggatggtcggattgtcactgggtgaatacgccgctttgatggcggctagggcgctagactttacaccgggaatggccttgttagccgaccgggcccgctacatgcaagaagatgccgaccaagtcccgtccacccttgcggcaattgttgagcccaagttggacgtggtcagccaagcggttgaagctgcacaagcggctgggcaaggagtttactttgctaactacaactccccggaccaggtggttttagggggggctaaggaagccttggaacaagtggttgaagaaatcacggctaaggaagcggcgaaaaaagccgttgtcttaaaggtctccggggcctttcacaccccgttctttaacggtgcgcgccagaagatgacggagcgcttaaagaccgtcgccttccacacgccaacggtgccggtgatttctaacaccaccgtgaccccgtttgaaaaggagggactggctgacgtcttggcccggcaactggcagtgccaactcactttggtgacgacttagcctacctgattaaccaccaaggggttgatacgaccttggaaattgggccgggcaagaccctcacccgctttgctaagcaagttgatcgcaagctgacccgctaccggatcagtagcctggccgattaccaggcctttgttaaggaggtttctgatggaactcaaggataaggttgtctttattaccggttcaacccggggaattggggcggcaaccgccctggcctttgctaagcaggggagccgcttggtgttaaacgggcgccacgacctcgatgatgatatgaagcaaaagctagaagcagctggcgccgattacaagttcttgattggtgacgtagctgatgaagaatcggtggctcaattagccaaggaggcttgggatgcctacgggcacatcgacgtcttggttaataacgccgggatcacccgcgaccgtctgattggcggaatgaaggtagcagactttgaccaggtgatcgccgttaacttgcggggaccgtttttactgattaaggccttgatcaagaagtttaacaagcaacgctctggtgccattatcaacctggctagcgtagttggattacacggtaatgccgggcaggccaactactcggcaagtaaggccggcatcgttggcttaaccaagacggtggctcgtgaaggggccatgcggggaattcgttgcaacgccattgcacccgggatgattgctagcgacatgacggccgccctttccgaacgggttcaagagggcatcgtggaacaaattccgcttaagcgactaggaacggtcgatgaagtggcacaatgcgcaatcttcttggcgcaaaatgattacgttaccggccaagtattggtcgttgacggtgggatgacgatttaggaggaacacaagatgacacgcgtagtaatcacgggaatgggcgccattgccccgaacggaaacggcttaaccgccttcgtagaaaacagtctggccggccaggtcgggatcaagaagatcactaagtttgatgccgaagagaccgggattgcggttgcaggtcaaattgatgatttcgatcccgctgaagtagtcggcaagaaaaacgcccggcggatggacctctactcccaatacgccattcaaacggcccaagaagccgttgacatggccggaatcaacgaagataacaccgccccagaggacatgggggtgatctttgggtctgggatcgggggcttaaccacgatccaagaacaaatcattaagatgcacgataaaggaccaaagcgggtttcgccaatgtttgttccgatggctatttccaacatggcggccggtaacattgcgattcgcttcaacgcccaaaacatgtgctcggcggtggtgacggcatgtgcttccgggacgaacgcgattggtgatgcataccgtcaagtcaaggaaggtcgagcccaggtaatgatcactggggggagtgaagcctccgttaacgaaatcgggattgccgggtttgcggccctgactgctttgtcaacgaccgaagatccactgaaggcctccaagccgtttgatgttgatcgcaacgggtttgtgctgggtgaagggggcgccgccatggtgctcgaaagcctcgaacacgccaaggctcgtggggcaaagatcctcggtgaaattgttggttacggggcgacgggggatgcctaccacatcacctcaccggatcctacggggaagggcgccgcgcgggctatgcaacaggcgattgacgaagccggaattacgccagccgaagtcgcatacgttaacgctcacgggacggctacccacgccaacgactctggtgaagcgcacgccattcaaacggtctttggcgaaggttccgaagttaaggtttcttcgaccaaggggatgaccggacacctcttaggggctgccggggcaatcgaagccgttttgacggttgctgccttagaacaaggaaagttaccagctaacgttggttgcgataaccaagatcctgattgcccagtcaccttggtaaccgcagaaaatcaaacagcaccacaagcacgctttgccatcagtaattcctttggctttgggggtcacaacgctgtgctgaccttcaagaagtgggaggatgattaaggatggaactcaaggatttagagaagctgatgaaggtgtttgaagaatccgacagtcgcgagtttaagcttgacgacggggacttccacctttacctgagtaagaataagcaccacgcccccgttgaggccccggttcaagcagccccggccccagctgcggcgccggcggaaccacaagccccagctcccgtcgcaaaggaggcaccgggggttagtgtgaaggccccgttagtgggtaccgtctacttacaaccgaaaccgggggccccggcctttgttaaggttggcgaccgggttgaagaaggcgacgtggtttgcgtaatcgaagcaatgaagatgatgaccgaaatcaagagtgatcacgcggggatcgtgagtgcgatcaacgttaaagacggggagttagttgaagtagaacaacccctgatcaccctcaaggaggactaacgatgagtaaggtaatgcttgatagtacggcaattcaaaagattatcccgcaccgctacccaatgcttttgatcgaccgggtcgaagaattggtgccgggggaaatggcggttgccaagcgcaacgtcacgatcaacgaagcggtctttaacggccacttcccaaacaacccggtgttaccgggagccttaatcgtggaatcactggcccaaactggggcggtggccctcttatcccaagaggatttcaagggcaagacggcctacttcggcgggatcgaatccgctgaatttcggaaggtggtacgccccggcgatactatgaggttagaggtccacttggaaaaggtccgcggccacattggcctgggcaagggagtggcaaccgtcgatggcaagcgagcttgcacggcggaactgaccttcttcattgactaaatagataggggaagagaagaatgtttgcgaaggttttagtagctaaccggggggaaattgcggtccgcattatccgttccttgagggaacagggaatcaaagcggtggcgatttattcgaccgctgaccgcgacagccttcacgttcagcttgctgatgaagcggtgtgtgtgggggggccccgcccgcaagactcctacctcaatatgaaaaacatcctggccgccgccattggaaccggggcccaggcgattcaccccggctttggtttcctatccgaaaacgccacctttgcccaaatgtgtgatgccgtcgggattacctttatcggtcccaaggccgccacaattgatttgatggggaataaagagcacgccagagagcaaatgcaaaaggcgggtgtgccggtgattccggggtcggatggttacgttcaagatgcccagactgccctagcggtggccaacaagattggttacccgattttgctgaaggccgctgccggtggtggtggcaaggggatccgaaagatcgaacaggccagtgacttggagaaggcctttagtgaggcccaggctgaggcacgggtatcctttaacgacgaccggatgtacctggaaaagatcatggaaaacgttaagcacattgaggtacaggtattccgtgatcgctttggtaatgccgtttacttcccggaacgtgactgttccctgcagcgtaataagcaaaaggtgatcgaagaaagcccgtgctcgttaatttcagaagataagcggcgtgagttaggtgagatcgccgtgcgggccgtcaacggaattgattacctcaacactgggaccctggaatttttgatggaccaggaccagaacttctacttcatggaaatgaacacccggatccaagttgagcacacggttacggaaatggtgacgggaatagacctagtcaaggcgcaactagtggtggcggctggggaagccctaccgtttacccaagctgacatcaaggcccaaggggtcgccatcgaatgccggatcaatgctgaggatccaaagcggggctttttcccgtcaaccgggaaggtcacttacttatacctaccagttggtaacctcgggatgcgaatcgacaccgccttgtacccgggggtaaccgtcagcccatattatgactcgatggtggcgaaggtaattgcccatggtaacgaccgtcaggaggccatttcgcgcctgaggcggttgttaaatgaaatggtaattaccgggatcacgaccaaccagaatttccacctggcgattctaaacgatccggtctttaatgaagccacctttacgactaactacttagaacaagaatttttgccacgctggaagggggaattggcaagtgaaactctacaaggcgaaaaacacccttagtgagcgccacgttcaagctgaccgaacggccgacgccaaggtccccgatgacctgtggcggacctgtccaaagtgccagcggaccttatttgccgcccagatggatgagtacgctacgtgcccgggctgcgggtacgggtttcggattagtgctaaccagcggctgagttggctggtggattccgcggtgccaatggacacggctttacaaactcaagaccccttaaatttcccgggttatgaggggaaattgaaaaaggcccaggaaaagtccggcctcaatgattcggtttggaccggccgtgcccggattggtgacgttgactttaacttagggatcatggacccgacctttattatgggttccttggggacgattaccggcgaaaagattacccgcctgtttgaagacgccacgaaaaaccagcgtccggtcgtcctcttcaccgcctccggaggggcccgaatgcaagaggggattatgtccttgatgcagatggccaaggtttcaacggcgattgctgaacacgatgccgccggcttgctgtacattgtggtcttaaccgacccaaccacgggtggggtgacggccagttttgccatggagggggacgtaattttggctgaaccgcgggccttagttggctttgccggccgccgggtgatcgaacaaaccacgcacacggaaatcccggccgacttacaggatgccgaaaacgtcttaaagcacggtttcatcgatcacatcgttacccgccaggatgaaaagacgaccttagcctggttaatgaagtacggggggaagcaaaatgactaaggaaaacgcttatgccattgttcaagccgcccgtagcgccgggaaggtgacggggctagagatcatcaaccaactctttgataacttctttgagctgcacggggaccgcaacgggaccgatgacccggcgatcattggggggctagccacctatcacggccgcccagttacggtgatcaccaccgaccgtgggaagacggttggtcaacgggttgccaagcactttgggagcccggcacctggtggctaccggaaggccctgcgcttaattgaaaacgccgctaagttccaccggccggtgattgccttggtcaacacggcgggagcctacccgggccaatccgccgaagaacaggggcaaggatcggcaattgcccaaaacctgctcaagattagtcaggctaagaccccactgatcaccctgatctacggggaagggggcagtgggggcgccttagccctggcctgtggcgatgagatctggatgctagaaaagagcacctactccgtcctttcgccggagggttttgcttcgatcctgtggaaggatagtagtcgggcaccggaagcggccgccgtcatgaagatgaccccccaggcactccttgaacaaggggtgattgaagggatcatcgaagaaacaactgatcaccaagcaaccattcaaaacattgatgttgtcttagaaaaacaacttgcaacgctggctcagctgacgcccgaggaactcctcaagcggcgccgggcacgatacagaaagttttagggggattaaacagactcatggaaggattattagcgaacaagacgattgtggtgatgggggttgccaaccgtcgttcgattgcttggggttgtgcccaggaaatggaaaagcaaggggctacggtaatttacacctacaaccgggaacggaccttaaagcgcatgactaagctggtgggcgaagaaaaggccgaccggatgattcaatgtgacgtggccagtgatgaaagcattcaacgggcctttcaacagattggtgaacaattcggccaactggacggggtggttcattccgttgcctttgccaacccggctgaactaggtggggaaatgaccgacgtttcacgcgagggttacgccctggcccaagacgtttcggcctactccttaatcgccgtttgccgggccgcagccccgttgctaaagaacccagctagcgtggtcacgatgtcgtactttggggccgaacgggcgatccctaactataacgtgatgggggtagccaaggcggctctagaggccaacgtccgctatttagcgcgtgacatgggtaaaaatggggtgcgggttaacgccatttcggctggcgccctgaagaccttagcggtgacggggattcaaggacatggtgaattattggccatgtcgaaggcccggaccgtcgatggcaaggatgttacgatcgaagaggtgggcggcaccgccaccttcttaatgagcgatctgtccaccggggtgaccggtgacgtaatttacgttgacaaaggtgtccacttaatttaatatttattcgcaattattcaattagtcccttgcgggggactttttcatggcatgattgtaaccctcttggattttttagggttacaaaagagaaaggatgaaaaatcaatgacgcaaagtcgtacacgtataactgaattaacccgggccgggatggtcctagccgtaattattgttttagccttcttcccggggatcccagtgggtattttgccggccccgattgtgttgcaaaacgccgggatcatgctggcgggtgaattattgggggccaagaaggggaccttggtcatggtttgtttctttatcctggtggccgttgggatgccatttttaaccggtggtgccggcggggtcgccgtcttcttcagtgcctcagcgggttactttgttggctggctcttggccccggcgatcatcgcatcgatcatgaacctcaaggccaacccatcttggttatgggagttcttcgccgttttaatcggtggggtactcttcatcaacttagcgggttcaattgggttagtcttcattacccacattagcttcaaggctgccctgattgggagcgtcgtctacatgccgggggacttgttgaaggccatcttgtgcgtaacgattagccaacagctccaccgggtggggtggcgttaatggcgaccaaagaacggctattagcccacttactttcagcgccaaaccagtggttttccggtcagagcctagccgaccaattaggcgttagccgggagtcggtttggaaggcaattcgttccctccaacaggccggctaccaaattgattcggaccgcaaacggggttattattaccgggggactgctaaaatgttggcacccgtaattgaactgggcctaggcaccacgaaggtaaaactagtggtggaagaggaactcgaatcaacccaaaccacggcccggcaactactagcaacgggagattcgaccgcccccctcgttgtgattgctgaccaccaaatcggggcctacgggaggcggggccgggccttttatgccccgaaagccacgggcctttatatgacgattggggttccaaacgttacctttcctgggcaaccaggcttgttaacgaccggagtggccgtaacggtggcaaccgtcttaaaacggtttttccccgcccaaagactgagttacaagtgggtcaatgacctgtacttgggacaccaaaaggtagtggggattttaacggaaatgcaaaccgacctggaagccactagccagacctctttggtaattgggattggcattaacttgaccactaaggaatttccggctgacttaaaagaaaaggtaaccggaattgacccggcggccacggttgatcgtaaccgtctagctgcggagttgatcgaagcagtcctaagcgacctccccgactattcccaagggatctttttaccggagtaccgggcacactccttgattttggggcggtcggtaagccttcaaattgggcaaacgacctttagcggaatcgcccaaaacattgatgaccaaggccaactagtggttagggcgcctaatggtcagctaagaaccttctcttccggggaggttactaaggtcaacttctaaggaggattgccttgcaggccacacttagacgcgagaccaaggataaccaattaacagccgaaaattaaaaacgaggttaagagtagtttgttagctcttagcctcgttttaatttagttatcaaattcttctagccgttcggcggccacggtccattgttcttcgacgtcttctagttgctttgtcagggcgtcgagctctttttgcaggtcggtcagtttgccgatgtcggtcgccacgtccgggtcggccatctgggtttcaacttgctcttgttgttcgcccaactggttcatctgttcttcaaggtcagcaacggtccgttgcaacttacggcgggccttttgggcttctttgctttgttggtaggactgttgggcagcggaaccagccttgggggcccttttttggtccggggtggttgaatcgtcggcgctagcttgttcttgttcggtgaccgcccgtaggtaatcatcgtaatccccccggtagcgggtaatgccgtctttttgcattgctaaaacatcggtagctacctggttgatgaagtagcggtcgtgggaaatgaagaggacggtaccgtcgaaatcgttaatcgccccttctaagacctcgcgactgtcaatgtccaagtggttagtcggttcgtcaaggatcaagaagttaatcggttcaaaggagagcttagtcagctccaaacgggccttttgtccccctgacaggtcgctgacgtgtttgtagacgtcgtcaccaacgaataaaaaggagcccaaaaggttgcggatctgggtttcatcaatttcggggtggtcgtcccagacctcgtctaagaccgtcttttccgggtgaagctgctgttgttcctggtcgtagtaaccaatgtctaggttagcgccgaacttaatcgtccccgcgatcgccggcatcttttttagcagtgtctttaacagggttgacttaccgatcccgttggggccaatgatcccgatgcgttggcccttgcgttcgttaaaggtgaggggaccagctaaaacggtgtcttggtagccaattttgaggccttcgacgtctaggacctcgttgccactctccttttgggagctaaaggagaagtggatggacttgtcatcggtttgggggcgttccatgcgttccattttttctaattggcggcgccgagcttgggcgcgcttggtggtggaggcccgcactaggttcttattaacgaagtcctcaagcttggcaatctctttttgttgttgttcgtaatgcttcatttccgttgccaagcgggcggtcttgtttttaacgaaggccgagtagtttcccgtgtagtggtggagggtttggttatcgaggtcgtacacttcgttgaccacccggtctaagaagtaacggtcgtgggagacaattaaaagggcgcccgagtagccctttaagtagtcttctaaccaggttaacacccccatgtccaagtggttggtcggttcgtctaagatcagtagctggggggcttgtaaaaggatcttggctagagccagcttggttttttgtcccccggataaggagttgacggggcgttggtagctttcttcttcaaagccaaaaccggtcaaaacgccgcgcatccgggagtcgatctcaaagccccccgcctcttggaactgttcttgcaggcggtcgtaatcccttaagatttcttggtagcggtcggtggttgaatcaaccgttgccaactgcccttctaagtggtgaatttcagcttccattttgtggaggggaccaaagacggtgtctaattccgcccagatcgagttctggctgtcaaggccctgatcctgggctaggtagccaatggaaagtcccttggccttggtgatggttccctcgtcgggctgggtgatcccggcaatcatctttaagagggtcgtcttaccagctccgttacggccaacgagggcgacgcgggcatgatcaacgacctggaggttaatattgtgaaataagacgtcggcgccaaaccggcggaggacatcgttagtttgaagtaacaacatgagtggtgatccttttcctattttagctacttcaaagtgtagcatagtttatcttaaaaccgaaaaaataaccaaaaagtaatgaatgttagttcacaaacaaactagaggttgttagaatgagtaaggaataatatttcacaatcaaagaaatggaggaattattatgccaaatcgtaaaattccccgtgccacggctaagcgcttacccgtttattaccggtacctaaacgttttattgaacgctaataagcaccgggtgtcgtcgacggaactttccgaagcagttcaggtggactctgccacgatccggcgggacttttcctacttcggtgagctcggaaagcgggggtacggctacgacgtcgaaaagttgttgaactttttcaaggggatcttgaagcaagacaagttaaccagcgtcgccctagtgggggtcggttccctagggtcggccctgatgaactacaacttccaccagagcaccaacctgcggatttcagcggcctttgaccctaaggaatccctggcgaacacggtcaagagcgggattccggtttacccggtcgaagacatgaaaaaacagattaaggagcaacaaatcgacgccgttattttgacggtgccgggttcggaatcgcaagcggtcaccgaccaactggttgaagccggggttcacgggatcctgaactttacgccagtccgcctgtccgtgccaaaggacgtgcaggttcaaaacatcgatttaaccaatgagttgcaaacactgatctacttcattgaaagcaacaaggttacgaccgacgacgaagattaatccgaagagagtggaaaataacttccgctgcgggtcggatgtaagagcgcatcgttcttcggcctgcttaggcactagacctgcggtgattggccacgttttctgtctaacattcggatatacagcaaggaggctgggaattcccagcctcttttttgtttggtcaaaattagtcaaagtttttggttgcatttcggggaaaaggtgttatattagaatatgtaattagcacttgagggggttgagtgctagcagagtgctcgtccccgtgctaaccactaatcattgacttgaaataatggagggataaccatgttaaaaccattaggagatcgtgtcattttaaaggcgcaagaagaagaacaaaccgttggggggattgttttagcctccaacgctaagaacaagccaaccactggggtggtagtggccgttggacaaggtcgcacgctggataatggccaagtggtggcggtcgccgttaaggaaggcgacaaggtcttgtttgacaagtacgccggcaacgaagtggaatacaatggtgaaacctacttggttgtccacgaaaaggatttagttgcggttgttgactaagaaattcaatgaggtgagataaagatggcaaaggaattaaagttctcagaagacgcacggagcgcaatgctgcgtggggttaataagttagcagacaccgtcaagacgacgattgggccaaagggacgtaacgtggtgttggaacaaagttacggctccccgacgatcactaacgacggggtaacgatcgctaagagcattgaattagaagaccacttcgaaaacatgggggctaagctggtttccgaagttgcttctaagactaatgacattgccggggacgggaccacgacggccactgttttaacccaagcaattgtgaacgaaggaatgaagaacgtgaccgccggcgctaacccagtgggcattcggcgcgggattgaaaaggcgacggccgcagccgttgaaggcctgaaaaagatgagccacgacgttaagaccaaggacgacatcgctcaaatcgcctccatttccgctgctaacaaggaagttggtaagttgatcgccgacgccatggaaaaggttggtaacgacggggtcatcacgattgaagattcccgtggggttgatactagcgttgacgtggttgaagggatgagctttgaccgtggttacatgtcccaatacatggtaaccgacaacgacaagatggaagccaacctggaaaacccgtacgttttgattacggacaagaagatctctaacattcaagacatcttgccactactccaatctgttgttcaagaagggcgcgccctgttaatcattgctgatgacatcactggtgaagcactgccaacccttgtgttgaacaagattcggggaaccttcaacgtagttgccgttaaggccccaggctttggtgaccgtcgcaaggatcaattggaagacatcgccgttctgactggtgggaccgtgatttccgacgaccttggtatgcaattgaaggacgctacgattgaccaacttggttctgctaacaaggttacgataaccaaggacgctaccacgatcgttgatggcagtggcaacaaggaagccattgcagaacgggttgaccaaatcaagaaggcaattgccgaaacgacctctgactttgacaaggaaaagctccaagaacggctcgctaagttagccggtggggtggccgttgttaaggttggggccgctaccgaaaccgaactcaaggaaaagaagtaccggatcgaagacgccttaaacgccacccgggccgccgtgcaagaaggctttgttcctggtggtggaacggcactggttaacgttatccctgccttggacgaagtggaagcatccgcaactggcgacgaagcaaccgggattaagattgtgaaggcggctctggaagccccagttcgtcaaatcgccgaaaacgccggtttggaaggttccgtgatcgttaaccagctgaagcaagaaaagccgggagttggttacaacgccgctgatgacaagtttgaagacatggtcgctgccggaattgttgacccaacgaaggtcacccgctcggccttgcaaaacgcagcttccgtttccgccctcctcttgacgacggaagccgttgttgccgacaagccacaacccgctgacgctgcaccacaagcaccagtagccggtggtatgggcggcatgatgtaatttgaaaattaattttttgggaggtgagtgcccggagctgtggcttcgggcacccaccttttttgcgtagaaacggtggtattcggttcacccggggtgtagaatagctgttgacttatttttaagaggagacaaattttatgtggcgctatcttaaacgtgtcttgatcgggaaaccattaaagacgcttgacgagggccagtcgcacttgacgaagtttaaggctttggccatgctttcgtccgacgccctttcgtcagtggcctacggtaccgaacagattaccacggttttagtaaccctttcgacggccgccatctggtattccttaccgattgccggcattgttttagttctgttgttagcaattaccttgtcttaccggcaaatcatccacgcttatccgagcggtgggggcgcctacgttgtcgccaccaaaaactgggggagcaacgggggcctaatcgccgggggctcgctgctagtcgactacatgttgacggtggcggtatcaacgacgtcggggacggaagcgatcacgtctgcaattcctttcctatataattattcggtccatatttcagtggtgattgtcttgatcatcatgttcatgaacctacgggggatgagtgagagtgctaacttcctgaccattccggtctattttttcgtaatcatgatgacggtgatgatcgtctggggtggctataacatcgctaccggtcacgtggcttaccacgccacggccaattacgggacgccggtagccgggatgtctgccatcctgttcatccgggctttttcggctgggtcatcttctttgaccggtgtcgaggcgatctccaatgccgtaccgaactttaaccctcctaagaagaaaaacgccgccaacaccttggcaatgatgagcctgatcttagcggccttcttcggtggggtgaccttcctgtccttttacctgggaattgtaccgaacccgcaccacaccgtcttgtcccagattggggcggccgtttttggtggcgagggcctaggttactacctcttgcaactgtcgacggcgatgatcttagccgtggcggctaacactgggttctcggcctttccaattttggccttcaacatggccaaggataagtacctcccgcacgcctttatggaccgtggggaccggctaggctattccaacgggattatttccctggcggtcggggcgatcgtgttgatcatcctcttccacgggaagaccaacctgttgatcccgctctacgccgtcggggtgttcgtgccgtttaccctctcgcagtccgggatgattatccactggttccgcttaaaggaagggagttggctggttaagtcaaccattaacctggtgggggcgttaatctcactagccctcgtgatcttcttgttctggcaacacttctccaacgtgtggccgtacctgatcatcatgccggcccttttgtacctgttccacgttattcacacccactacatcaaggtgggaatgcaactgcgggtagcggaaaaggctaaggttcagttgcatgattacgacggggccaccgtgattgttttagtcgggaacgtgacgcgggtcaccaagggcgccattaattacgcccgttcaattggggattacgtcattgccatgcacgtgtcctttgatgaaaacccgggtaaggaacataagacggccaacgaatttaaggccgagttcccggacgtgcgtttcgttgatattcactcgtcctaccgctcgattgccacaccaacgttacggttcgtagacgtgatcgccaagcgggcggccgataagaattattcgactaccgtattggttccgcagttcgttccaaagcacccgtggcaaatggctttgcacaaccaaacgagcctacgcttgcggaccctgctgaattcgcgggaaaacatcgttgtttcaacttacaactatcacttgcatgaataattgatgggggaggggagaattagagttcttccggcccctttttgatttttgaattttacacagataacgtgggaaataaccgtcggcctagtggctaagtatgggtgaagaacaccgcgttccgcgctaacctccccctagcttaacctaacgacctgccaaccagttgtttcccattcccccttaacgggaatatttcccgggaaatggatgcacttatgaaacgaaaaattataaccgtggttacgggactggtggggattatcttaatgatgtcctttacgattcaacaagagcactttcactcgggaatttacggggtgctcgggagtattctattggtgggtgcttacgttagtgcccactacgaagcctggcgggaacatgaccgccgggtgcgccacgttaccatcaccttagcggtgctctgcgttctcttggtggcactgaacttggtggagcagtttatataaaaaagtggcagtacaacaagaggccaggagaaacactgttttctcctagcctctcttgttgtattctcgaatgttagacagaaaacgtgggaaataaccgccggcctagtgtttaagcaggctgaagaacggtacattttgcaccacctattcggctaggattagtcagaagacctgccgagagggttgtttcctactaattatttaaggggacctcgtgaaaacgttggtcctcctttttaatttggagttggtggttgaagcggtcggtgagggtttggatctgttcgtcgacttcttctaggttgatgaagacccggatggtgacgtcaacgccatattcctccccagccagggccaaccccgcctgttctaagtagtagtggacctgatcgttgaggcggtagggaacagtgatggcgaccacctgctgggtgattcgctcaaccaagccggcctgggtaattgcctcggtggtgacgttggaataggcacggattaacccgccggcgcccaacttaattccaccgaagtagcgggtgaccacggcacagacgtcgtggacgtgggcgagctggagggcctctaagatggggacaccggccgtgccactgggttcaccgttatcactttcccgctggatctgatcgttatcgccgagtaggtaggcgtagcagttatggttagccttgcggttttccttgctgatgcgggtgatgaagtcttgggcttcttgttcactgtgtacccgggctaggctacagatgaagcgggattttttgatgactaattcgaattccgtgttttggtggatggtcaaatattgtactgccaaaaaagggcctccttacgttactaaaagcactttccccgtatttaatggtaagggggaaaaaccatgcaaaaagaagaattatacgggcgccgggttttaattaaccaagccttgcccgctccgtttgggttaacgggggaaaagacgatggatgaacggggacgctgggttacctgccgccggtgtaacgcccgcttaattaaggaacgggttcgcttaccaagtggggcctattactgtccagtgtgcctgaatttggggcgggtgacaagtcatgatcgattttatcacttagccgaaccaaatcaatttaccccgcccactaacccgtgcacctggcaggggcaactgagcccgctgcaagagcgggtagcgagtgaggtggcggccgggatggcggcccaccagcaccggctattatgggcggtcacgggtgccgggaagaccgagatgatctttccggcactaaccggcgcactaaaacggggtgaacgggtggcggtggcctcgccgcgcgtcgacgtatgcttggagctctacccgcgcctgcaagcggcctttgcgggggtaccaattgccctgttgcacggcaagaatccggcaccctaccagtaccgacagttgaccatctgtaccacccaccagttattacgcttctaccacgcctttgacaacctagtgatcgacgaggtagatgcctttccctttgctggggatccggccctgttatttgccgcccaccaagcgatcaaagagggcgggggactcctttttctcaccgccaccccgagcaaggaattgctccagcaggttcaccaaaagaagttggcggtttcttacttgccccaacgtttccacggccacccgctaccccagattcaaaccgtgctggttggcaagtggcgggcgaagctaacaaagggaaaactacccaacgccgtttcggtctggttaaaacagcgggttactaagggacaggagtttttgttgttcctgccccacgtcgccgacctcgctccggtggcccgggcgctcaaagaaaacttgggggcggttaagtttatgacggtgcacgctagcgatccgcagcgccttcagaaggtccaggcgatgcgggagcgccagttgtcttttttggtgaccaccaccattttagagcgtggggttacctttccgggaattgacgtcggcgtcttgggggcggacgaggaggttttttccacggcggcgttagtccaaattgctggtcgagtggggcgttctaaggagcgaccgggcggcgccgtgaccttttgggttcaggaaaatagccggcgcattgaggaggccaagcaacaaattaaatcgatgaaccggcgggcacggggggtgagcaaatgaactgcctattgtgtaacgccccgattaagtggcgccccccggtcaaagatattctcagttttaagcggttagtgccgccgcaactatgtggcacttgttcccagcgtttcaccgcccgggaggcaggacgggggtgtccgtattgtcagcgcccggggtttacgacgacttgtccggaatgtgagcagtggcaagtgcgggccggtttcattttaacggtccgcgcttgctttggttataacgaggcgatgaaggaattcatgcacgcctataagttcgtcggggattaccgtttgcgccaagcctttagtgccccgttgaccaagttagtacaagaacagggggcgcaaatggtggttccgcttcccttacaccaaaagacccagcttctgcgtggctttaaccaggtcgaagggttactggagtgcccctttgaaaggttgttggtgactaaggaccaggaaaaacaagaaccccagtcggccaaaacgcgggagcaacgcctacagacgccccaaccgtttgacttaacggatcgaaaacgggtacgggggaagacagtggttttagtcgatgatgtcttcacgaccgggcgcactatgtaccatgcggcccagctaatgcgcgcggctggatgcaagacaatttgcggggtaacgttagctaattaggagatagtggaagcgatttccggatcttgtttgttaaatgaggttggatcccttataatgaagataggatatgagaagagtggtccttctgatatcagaacaagccagtgcttgtactgaaaggagagaagtgcaatgttaaaattcaatattcgtggtgaaaacgttgaagttactgatgccatccgtgattacgtagttaagcggatctccaagttagagcggttccttgaacccaacgtggaagccaacgcccacgttaacctgaaggtgtactctaaccgtacttacaaggtggaagtaacgattccgttgccttacctaacgctgcgggcggaagaaacctctaacgacatgtacggaagtgtcgatctggtgactgataagctagaacgtcaaatccgtaagtacaagacgaaggttaaccggaagtcacgggagaagggttacaagaacctggaattcgttgacaccccgagtgaagaagtagaggcaagcgacagcctgaagattgttcggacgaagcagatccccttgaagccaatggactctgaagaagccgttcttcagatggatatgttgggccacgacttcttcgtttaccaagatgccgaaaccaatggtacgagcattgtttaccggcgtaatgacgggcgctacggtttaatcgaagttaactaggcaaaaaggtgttagcacttgtgctagcgccttttttagttggcgtgattagttttcattgccggggcaaacatggtaaaattgaaagctgataaggttatttcgataaaaaaaggggtcggcgaaggcctaaacaccccaaatctgtgaacaaaggaaagggacacttcatggcgaacatactcagaaagtggattgaaagtgaccggcgggaactacgccggattaaccggctggccaaccgggtggatagttaccaagaccaaatggccaaattaaccgacgacgaattaaaggcgaaaacacccgagtttcggcaacggattcaagatggtgaggacctcgatcacctcttgccggaagcctttgcggtcgcccgggaaggcgccaagcgggtgttgggactcttcccgttccacgttcaggtgatgggggggattgttcttcacgaggggaacatcgccgaaatgaagaccggggaagggaaaaccctgaccgccacgatgcccgtctacttaaacgccctgagtggtaagggggttcacgttatcacggttaacgagtacctatccgaacgggacgccgaagaaatggggcaactctaccggtggctgggttgttccgtgggggtcaacggggcccaaaagtcaccggatgaaaagcgggccgcctacgcttgcgacatcatgtactcgaccaacagtgaaatcgggttcgattacctgcgtgacaacatggccgtttacaaggaggaccaagttcagcgggggttgaacttcgcaattgtcgacgaagtggattcaatcttgattgatgaagccagaacgcccttaatcatttcgggaccgggaacgggaacgtcaaagctttaccaacaggccgaccgcttcgtgaagaccctcaagaacgaagacgactacaagatcgacctggaatcaaagaccgtttcgttgaccgacgaggggatcaaaaaggccgagaagtactttaacttaaagaacctctacgacccggaaaacaccgccttgacccaccacttggaccaatccttgcgggctaattacatcatgctcttggacaaggactacgtggttaacgatggggaagtcctgatcgtggactcctttaccgggcgggtaatggaaggccggcgcttctccgatggcctccaccaggcgattgaagccaaggaaggcgtcgaaattcaagaagaaaacaagacgatggccaacatcacctaccagaacctcttccggatgtactctaagctagccgggatgaccgggacggcgcggaccgaaatggaagaattccgggaaatctacaacatggaaacgatcacgattccaaccaaccggccagtggcccgggtggacgagccggacctcttgtacccaactttagaaagcaagttccgggcggtcgtaaagcggatccaagctctccacgaaaagggccaaccagtcctggtcgggacggtggccgttgaaacctccgaatacctttcccacctgttggaccaacaaaagattccccacgtggtcttgaatgccaaaaaccacgcccgggaagccgaaatcgtcaagaacgccggtcaagttggggccgtcacgattgccaccaacatggccgggcgggggaccgatattaaactgggcccgggggttaaagaactcggcggcctagcggtgatcgggaccgaacggcacgaatcacggcggatcgataaccagttacggggacggtccgggcgtcagggggacccggggctgtcacagttctacctttccctagaagacgacttaatgaagcgtttcgggggcgacagaattaagaacttcttgcaacggttacaaactgacgacgatgacgaagacgtggtcatcaagtcccgtttcctgacccaccaggttgaatcggcccaaaagcgggtggaagggaacaactacgattcccgtaagaacgttttgcaatacgacgacgtgatgcgcgaacagcgggaaatcatctaccgcgagcgacaacaagtgatcaccgaaaccgactcgctcaagtgggtcctgatgccgatggtcaagcggacgattcagcgggcgattgatgcccacaccctgggggataaaaaggactggaagctccaagaaatcgttgactttgcggtggaagtcttggttaagccggaccaaatcacggttggaatgcttgagggcaagtctaaggatgaaatggtcgacctgatgatggactttgccgaacaggtttacgaagaaaagaagcaccagctctacgatgactcccagatgctggaatttgaaaaggtcgtaattttgcgggtagttgacgcccactggaccgaccacatcgacgccatggaccaattccggcagtcggttgggctgcgaggttatggccagcaaaacccgttggtcgaataccaaacgacggggtaccggatgtttgaacaaatggtggcagacattgaatatgaaaccacccgtctgttcatgaagtcagaaattcggcaaaacgtaacgcgttaacaattaggcggtggcagtccgaaacggtaccgcgaccgccttttgaattgaggtaaaaaatggaactaagtgaagccacaaaacagatagaagcaatgcaggctgaggttgcacgcttcgggaggtctctttgacctcgatgctttaaacgaatcgattgcccagggtgaaaacgaaatgacggcgccggatttttgggatgataaccaacgggcgcaagaaaaggtggcggcgttaaacgagttaaaaaagcgtcgggacaacttcttaaccttacaagaccaagtcgaagagctcgccttgacggcggaaatgctccaagtcgaaccagacccggagctaaaagccgagctagacaacaacttccctggtgtccaagaacacctccgggcttatcgcctggagcagttacttgacgggccctacgaccaaagcgacgccattttagaaatccaccccggtgccgggggaaccgaagcccaggattggggcgaaatgctgttacggatgtacatgcggtgggccaaccagcacggctttgcggtggaaacggccaattacgaagcgggtgaagaggccgggattaagagtgtgaccctgttaattaagggccacaatgcgtacggctacctgcaccccgaaaagggggttcaccgactggtccgaatctcaccgtttgattcggccgcccggcgccacacctcctttgcttcggttgatgtgatgccgatcctggatgaatcgattgaagttgaaattgacccgtccgacttgcgggtcgacaccttccgcgcttccggggccggtgggcaacacattaacaaaacggaatcggcggtccggattacccacttgccgaccgggatcgtaacgtcctcgcaagcggaacggtcgcagttgcaaaaccggatcaccgccatgaacatgctgaaatcgaagctctatgaactagaggaagaaaagaaggccaaggaacgggcccaaattgaaggggaacaaagggaaattggctgggggtcacagattcgttcctacgtcttccacccctatacgttggtcaaagacgcccggaccggttacgaaacccacgatgtgatcggggtgatggacggggacctcgatcccttcattaacgcctaccttcagtggaacctcgcccagaagaatccccggtagcatggattgcgcccggggctaaaagcaagtaagataatcgcaaaagaagggaaggatgcttatgcaacgaccacggcatcaaaagctgacccgctcccgaaccaatcgcgtcttggcgggggtgtttggtggctttgccacgtactttggaatttccgccacctggcttcgaattgcctacctagtgttgaccgctctgtccggcttggttcccggcaccatgatctacgtgatgacggcgattatcatgcccccggcgccaagtagcaacggggccttagataacttcttttggggtaaccgcgggactgaagcaaccaagaaaagccggcgcgaactccaggatgtagaggaagaagacgtcaaaaggggagctgataaatagtgggctttttaaaaaacatcattatcgatgccatcctatttgtggccctagctggtctgtttgctaacaccggctggttttacgtcacgagcgtttggacggctctagtagcggccatcgtgttggcaatcttaaacgccctgattaaaccgattctagtattcctatcgttaccaattaccattttgaccctcggtttgttttcgatcgtcatcaatggcttgatgctacagttgacggcgagtttcgtcggcccggggattcatttctcttcgttttgggcagcgatgttgatcgccctgattatgtcaatttgcaacaccattattagcaatcacttcgctaatcaataaggaggagaaacaacatgcccaatgttgattcagttaccgtcgccgacttggcccaaaatgtgcgcctaacggttttacagggggaagattacctgaaccgccagattaccacgagtgacatttgtcgcccgtccttagagtttgccggttactttaagcactacccggccatgcgaattcagctgctcggaatcaccgaaacttcctttgctaaggaagtgccggcggacaagcgatgcgagtacattgaaagaatgtgcaccccgcaaacgccgtgctttgtggtctccaccgacctaccggtgatggacgaactcaaaacggccgccgaaaaggcccacatcccaatcctggggaccccgctaacgtcctcgcgaattttggggaacatgacttcctatttggtcggtccactggccccacgtgaatccttacacggggtcttggtcgacattagcggggtgggggtgttaatcaccggtgactccggagtcggcaagtccgaaacggcattggaattagtgcgtcggggccaccggctggtcgccgatgaccgggttgaagtatacgcccgcgatgaacagaccctggttggggcggcgccgacgatcctccagcacctgatggaaattcgggggattgggatcatcgacgttatgaccttgtacggatcgggggccgtcttgccgcaggacacgatcgacttcattgtccacctagaaatctggacgcccgattcccagtttgaccgcttaggcgatcagggcgatactcagttcatccaagacgtggccattccgaaggtgtcagtaccggtgaagaccgggcgcagcctcgccatcattatcgaatcggcggcaatgaacttccgtgcccagacgatggggtacgatgccactaagacctttgacgaaaaccttaaccgcctgatccagcaaaactcagaacgtgaccgaaaggaagcggagaatgactaagcttgtgctgggggccctaaatccaattgccctccagtttggcccttttaccgtccactggtacggggtgatcattgccagcggggtggtgttggccctgtggctatcaattagggagggggcccgcctggggttaaacgaagacgtcttttatgactacttattgtgcgccctgccggttgccattatttgtgcccggacctattacgtgacctttgagtggcagtattattccgcccacccgagtgagattatcgctatttgggacgggggaattgccatctacggggccatcatcgggggctttttgacgatggcgatcttttgccattaccgtcacgttaacatgtggaccctattagacgtggttgccccgaccgtaatcatggcccaggggattgggcggtggggtaacttcatgaaccaagaggccttcggggtgattaccacgcgggcttccttggtcgcccaacaccttcccaactggatcatccaacaaatgtacattggtggccactaccgggtccccacctttttatacgaatcgttgggtgacctagtgggcttcgccttgttaatgttacttcgccaccgccaccacctttttaaacggggggaggtcttcttagcctacgtatcctggtacgcgtgcgtccggatggtggttgaggggatgcggaccgatagtttgatgctcgggggcctccgggtttcccagtggctatcggtaattttcttagttgtagctgtttgcacctttatctaccgtcggcgccaccaagccgacttgccttggtacacgagtttattcgtaccagaagggagtcagaaatcatgaaaaaagtagccgtcctcggggccggatcctgggggagcgttttggccaacctcctcgtcgaaaatgggcaccaagtaatgctgtggtcccgcaaccaagcccaagttgaccagttaaaccaagaacacaagaacccacattacatgaaggattttacctacaacgaagggttagtagccactagcgacatgcaagcggccgtgagtggggcagcggtcatcttgatggtgatccccaccaagggggttcgtcaggttgccggtcaattggctgaactactaaacggcgtcacgccggcaccattgttagttcacgccactaagggcttagaacaaaatacctacaagcgggtttcggaaatgctagccgaagaaatcccggcggcttctcgccgcgggatcgtggtcttgtccgggccgagtcacgccgaagacgttgccatcaaggacgtgacggcggttaccgcagcctgtggtgacttagcgtgcgcaaaagagatccaagaactcttttcaaaccactacttccgagtttacactaatgacgacgtaattggcgccgagttcggggccgccttaaagaacatcatcgccctgggatccggggccttaagcgggttaggttaccacgataacgcccgggccgctttgattacccggggcttagcggaaatccgtcggctcggggtggcctttggcgctgacccgatgacctttattggcctctctggggttggggacctagtggtgaccgccacttccaagaactcgcggaactggcgggccggctaccaactcggtcagggccagaaactcgccgacgtggtggaaaacatggggatggtcatcgaaggggtagcgactaccaaagctgcttacgagttggcccaaaagcgtcacgttcagatgccaattaccgccgctttgtaccgggtcctctatgaagacgaagacattaagtccgccattgacggcttgatggaacgggaagttacttcggaaaaagaataaatttgtggtaaaatgagagcggctccatattgagaatttaacatggaaggatttaagttagtatgaaacaagtaagaaaagcaattattccggcagccggcttagggacgcgttttttgccagccaccaaggccttagcaaaggaaatgttaccaatcgtcgacaagccaaccattcaattcatcgttgaagaagcccgtaagtccgggattgaagacatcgtggtggttgatgggaagaacaagcgctccatcgaagaccacttcgactctaacccagaactggaagataacctgcgcgataagcacaaggatgagatgctcaagctggttcaagaaaccactgacattaacatctacttcatccgccaatcccacccacgtggtttgggggacgccgtgttgaccgcccgtgacttcattggcgacgaaccgttcgtggtaatgcttggtgacgacttgaacaacattaacggcgatgccgaaccgttgaccaaggaattaatcaactcttacgaagaaaccggtgcatcaaccttagcagttatgcgggtgccgcacgaagacaccgccaagtacggggtcatcaacccaagcaaggaagtaatgccgggtctttacaacgttacctccttcgtggaaaagccggaaccaaaggatgcgccaagtgacttggccatcatcggccgctacgtcttcacgccagaaatttttgatgtactggccaagaccaagccgggtaagggtaacgaaattcaactgactgatgccatcaacaccttaaacaagacgcaacgggtctttgcccacgaatacaagggtcaccgttacgacgtcggcaacaagtttggctggattgaaactaacattgaatacggcctcaagcacccggaaaccaaggatgaactccgtgagtacatcaaggatttgggcgttaagttcgccgctgaagacaagaagaagccagcaaaataaacgatcatgaggaagtggagccaagtttggttcgcacttcctttttgggtgcaccaattccaaccacaggcctagtgactaagtacgggcaaaaacagtgcgtgggtactaaccgaggccctagcttagcccacggcctgtcgaggaaggttggttcacacttctcttttattttccatcaagggttgacactagattaaaaagcaattaatatctaaccaacaaatgataaaataattaagagcaaatgtgatgatgagtaaagcggtacgccactacgccagagatttcccggtggctggaagggaaaagggccccgcttgaagatggtcaccaccagccccagggtgagggaacaagccttgggcggtgcggcgccgttaccggccggtaggtcattgacccattgaggtgctccctgtgaggggggcgtgaaaaaaggtggtaccacgggatcgtcagcccgtcctttgcgtcgaaaacgacggaaggggcgggcttttaattttaggaggtgttcaaatgagggtggcaattgatcaattagacgtggcgttggcaaggccagaccaaaactttgctcaggtagcagctgacgttaaagaggcggctaaggcgggagcggacgtaatcgtgattccggaaatgtggaataccggttacgcccttgaccaactgggggacttagccgaccttgatggtcaacgcactaagcagaccctagcaaggttagccagggacaatcaaattaacatcgttggcggttcggtggcgattaagcgggggaaacggttctacaacacgacctacgtttatgatcgaaccggtcaattggttggcgattacgacaaggtgcacttgttcggcctgatgaatgaaggagaattcatttcagccggccacgccccgaaccgctttgcattagacggggtgaaggccgccagcgcgatctgctacgacctccgcttccccgagtggctacggacgatttctaagggtgggagtcaaatcctctttttaccggcgcagtggcctgttcagcggattgatcagtggcgaatcctgctccaggcccgggcgattgaaaaccagtgctttgtcgtggcggttaaccgggttggtgatgacgccgccaatcactttggtgggaattcaatggtgatagatccgttagggaaggttttatttgaagcgggcgaggaacagggcctcttttacgtggacatcgacccggctgaggccctagcaatccgggggccgattcccgtctttaatgaccggcgcccagacctgtacgaatagaaaggaagcaagaacatggaatttccggaatcagaactactgcagggcttacccaaacaattcttcgctaacttagtggccaaggtcaacgctaaggtggcgacgggggcggacgtaattaacctaggccaggggaaccccgataagccaacccctgattacattgtagccgccacccaaaagtgggttgccgacccggccacccataagtactccctcttccggggactgcccgcttttaagaaggcggcagccgacttctaccaagaaaagtatggggctgacttcgacccggaaacggaagtggccattttggggggttctaagatcgggttggtcgaactaccatgggcgctaatgaaccccggggagaccttcttgttgccggacccgggctacccggattacttatcgggggcggcactgggcaaggtcaagtttgaaacttacccactcctagaggaaaacaacttcctaccggacctagctaagattcccgcggaggtggccaagcgggctaagttcatctacgttaactacccgaacaacccaaccggggcggtggccacccttgatttttatgaggagttagtagcctgggccaaaaaataccaggttggcgtggtctccgactttgcctacggggcaattggctttgatggccaggccccggtctccttcatgcaaacaccgggtgccaaggaggtcgggatcgagttttacacctactccaagaccttcaacatggctggttggcgggtggcctttgcggtcgggaatgccgacatcattgaggcgctcaacttgatccaagaccacctctttgtgtcactcttcccggccttgcaatacgccgccattaacgccttgaccgacccgcggcgggatgcggcaatccaagaaatagttgaccgttaccaggcccggcgcgacgcctttattgaggcggcccaaaagatcggttggcgtccaatcattccgggggggaccttttacgcctacatgccgacgccggccggctacacttccgaagactttgccgacctcttgttagagaaggcggccgtggcggtggccccggccaacggtttcgggaaaaacggcgagggttacgttcggattgggctcttgattgaaccggcccgcctggtcgaggccgtcgagcggattggcaatttacacttgtttgattaacacagtacataggaggataaatcaatggctttatcatatacggttttaggtgctggggcgatgggactacgcttcggggtattactgcaagaattaacgggcgtgaaggtggactttgttgacaactggcagccccaagttgacacgattaaggagcaggggggcgtctacgtttcccgcgaccacgaaaatcggcacttggttccggtgaacatctacgccccggaagaatatcacggcgacccagacgtcttaatcatctttgccaagcaaatgaccttacaagacctcttggagcgcagcagccacttctttgccccggatcaccagtacgtcttctccgggatgaacgggatgggccatatcgaaaagatcaaccagtacttccccaaagaaaacgtgatcggcggcacctgtttaatcgggacggtcctaaacaaggcgggggacgttgacttcatcggtaaggctggtgccggttcgatcaacttggccccgcaaagtggtcgggtggacgacccgcgggtacaagaaattgtcgccgactttgaaaaggccaacatccactgtaacctaaccgataatttctacggtaccctgttgaccaaggtggtctttaactcggtgatcaacacgatctgcaccctctttgaaatccagatgggtcagttcattaagtcaccggccgccgaaaaactgggcaaacagttaatcaatgaggcctacgacgtggtagaacgggcggggatccagctcctgtcgacccgagaagaggaatgggagacgatccactacgtttccgccgtctctaatccccttcactacccatcaatgtaccaggacatgagtaagaaccggccgaccgaggttgactacatcaatggttacctttacgacctggggcaaaagtacggctaccaagccgacactcacaacttcttgcgtaacttagtgcacctagccgaatcgacccgccagcaacagggccacggcgaataattaatacaatttgggtatcaaaggtgagtcagaataggtttttcacatttaattaatattagctggaaatcccgtgactttagtcatgggatggataggccactattgagcccctttatggggctttttgtttgtttctgtatatttttggtcattgatatatttctcgacaacttctttgctcatattgcccaatgtactcatatagtaactcggcgaccaaagatgaccgccccaatattggctacatcgtatttctggatgattctgtaaaaaaatataggcactacgtcctttgagcgccttaatggcactagccggagctttgcttggcggaaaactgatcagcatatgaatgtgatccggcatgacttccatcttttcgattacgatgtcattgtcatctgcaacttgctgcaagatagctttcatttcgttagataagacctcggttgtaaaagtctgattgcgatacttagttacccagatcaaatgataatggaaattatagatataacgacgagtataaatggcatctttgattttttctttagtcataatatgctctcctttgttaatacattgacatcatgatataatgttatcatatcaataaaggaggtgaaataaaatgaagtcaatggcaaaaatgaaacatcattatggcctaaaaatgcgctgctatcctagtgaccaacaaaagcagttgattaaaatcaacagtgacgctagtcgctttatctataacgaaatggttgcgatcaataaggaactgatgcagcttcgcagagttaagctaccgattgacatagttcaggatcgtattaagcaactaactatgcgccaaaacgctaagcaaatgtctaatcactatcaattcttagaagataaacgaattgatagtttgacgaaagctaatgccattcagaactatcgaaaagcttggaatgcttttcggaaggttcacgccactggtgttcccaaatttcatcgaaagagttatcactggcggtatcaaaccaattgtcaatacccggggcaaaaaactgcgttgctaactaacggtacagtctgttttctagataatagtcatgtcaaagtacctaaaataggactgttacgtgttgccggttcgcaagcacggcttttgaaaagaatatgcgagactagaattggtaccgtgacgttgactaaagattcagcggatcgcttctttttatcaatgcagttagcttcagatgaatcttttgttaaagtgtccaaagctactcatggacatgttggaattgatcttaatactgataacttcttaaccgacagtgaaggcaacatagttcctaatccacgatattaccgcactattaaaggcaaattagccaaagaacagcgcattttatctagacggcaacaacgtgcaaaaaaagaacatcgttctttacgagatagtaaaaattatcaaaaacagcgcttgttagtcgctaaactccataccaaggtaatgaaccaaaggcataattttctccaacaaatttctaccgcattaatcaagaaccacgatttagtagtagccgaggagttgcgtagcaagaatttgcttaaaaatcatgctttggcacttagtatttctgacgttggctggcgaacatttcttggcatgttggcttataaagcaaagctttatgggcgtcaatttatcacaatcaacccaagaaatactacccaaacatgtcgcgattgtggctttgtaatgggcactaatgggaaggacaaactaacattagatgatagaaactggacttgtcctaactgtggtattcaccatattcgtgactggaacgcagctaaaaacattcttgataagggaatagctaaactagcctagcttatctgtccctatggcaacctggggacataaaaggcgttggtaattagacgaccgctgtttgattacaatttcagttggtcaaataagttgtccctatctacgcaaattgtggttcgaaatccgtgatgatattcggctcacaagccactgactttagtcagtggtggttgacctaacccggcgctatcattaacttagttcaataaatggaggaattaatgatggcaaacaacgaagaagcagttaaaaacgacctgtttggttttggtgacaagaacgtcgcctttgctaagtactttatcggtgactcctacttaaatagtttgatctccgccgatgacaacattgatgttcacgtggccaacgttagctttgaaccgggctgccgcaacaactggcacgttcattacaacggctaccaattactgctggtaaccgctggggaaggctggtaccaagaatttggtaagccggcccaaaagttgcacccgggcgataccgtggcaattcacgagggggttaagcactggcacggagccgccaaggactcttggtttagccacatcgccatcaccaagggctcttcggaatggttggaagaagtttccgacgccgattacgctaagttagctgattaaaaaaatggggtgccgatgagtgaatgaccggcgccctttttattcacatccaactaacaaaaagtaagttaaatcgttagactttcctttagttagcaagtatcataaaatcaacatatgaccaagcgaagattaaaggaggaaacacgatggcagaagagaagcaaatgaactatgacgtagtggtaattggggctggcccaggggggatgacggcggccatgtacgcttcccgagcgaacctgtccgtgttactgttggaccgtggaatttacggggggaaccttaacaacactgccacgatcgaaaattacaccggcttcaagaccgttcaggggccggaattagcccaggatatgtacgacggggcgacccagtttggggcgacttacggctacgggacggtaacggcgttgaccgtcaacgaagatggcaccaagagcgtgacgaccgacatgggtgacaccttcattgccaaggcggtcgtgattgccaccgggtccgatcaacgtaagctcggcgtaccgggtgaacaggaatactccggccgcggggtttcctactgtgccgtttgtgacggggcctttttccgcaacaagcacctgatcgtggtcggcgggggtgactccgccgttgaagaggggatgtatttaactcagtttgccgacaaggtaaccgtcttggtgcgccacgaccacttgaaggcccaaatggtagcccaggaacgggcgaagaagaatggacaaatggagttcatcttcaacactgaggtaaccgaaattaagggtgacgataacaaggtgaccggggtcaagacccacaacaaccagactaacgaggatggtcacatcgacgctgatggggtcttcgtgtacgtgggggttgtgccaatgaccagtgcctttaaggacctgggcatcttagacgaacggggctgggtcaagaccgacgagaagatggccaccagcgttcccggtgtctacgcggttggtgacgtccgcaacaccgtccttcgccaaattgcaacggcagttggtgacggggcgatcgccggtcaacaaatcttcaactatattagcgaaaacgattaaggataggggggcatggcaatggaggccctgcggattggggtgctaaacctcatgcacgacaaggaggcgactaggcgtcgttttacccgggtccttgaacaacccggcctgccggttaagctgaccttcttttacccggttacccactacactggtcgcccggtaccagaggcggtggctaagattgcccggcccttggacctggaactagccgcccagatggatggttttatcatcactggggcgccgatcgaaaacttgccctttgaccaggtagagtacttcgccgaggtgtgtgacctgattgacgttttgaaccgggcccgggtctttcaactttacgtgtgctggggggcgatggtggcggccaactacctgtacggcgttgaaaaacaccggctggcaaagaagtacttcggcgtctttgaaaaccaagtcgtggcccccgaccccctcttagttgggctggaacctaacttcttggccccccacgcccgttacgccgagctaaacgagggggagttggccccagaaatggtggtaacggcgcgttcaagtgagggctacttgctagccgctcgggcaaccgcgtaccagagcttcttgtttgcccacctggaatacgggcaaaatgccctgttagaagagtaccagcgtgaggtggctgcccatcccacgcgtcactaccaaaagcccgtgcactactttaaagatgaggggcgaatgcaaggaccagagtttcgttggcgagccacccagcaacgctattttgcaaactggttgaacctggtggccactaagcgcctcttgggcgtgtgtaaagtcagttaacgatgaaaggaagatgtccaatgagtaaaatttatgattctgttgatcaattaattggtaacaccccgctggttaggttaaaccggttagtggaaccagggatggccgacgtttacctgaagctggaatccttaaacccggctggctcgatcaaggatcggatcgccctagcgatggtcgaaaaggctgaacaagagggtaagctcacccctggggggacgattgtggagccaacctcaggaaacaccgggattggcctggcgatggtggcggccgctaagggctatcacttggtgatcgtaatgccggaaacgatgtctgtagaacggcgtaagatgatgcaaggttacggggccgaactaatcctgacgcccggggacgccggaatgaagggctcgattgaaaaggcgaccgaattggttaacgagaagggctacttcatgccgatgcagtttgaaaacccggctaacccggccattcacgaacaaacgacgggccaagagatcattaacgcctttggcaaggagaacctccccgacgcctttgtggcgggggtcgggaccggtgggaccctgaccggggttggtcgggccctcaagaaggtcgatgatcaggtcaaggtctacgccctggaaccagcggaatcaccgttactcaaggaaggacacggtggcaagcacaagattcaagggatctcggccggctttatcccggccaccctcgaccagaaaatctacgacggggtggtcgagatttcaagcgaagaggcaatcaagacggcccaagcggtggcccaacaagaagggatttcgattgggatctcggcgggggcaaacgtggccggcgccctccagttggctaagcaactgggggccggccataaggtcgtgacggtcgccccagatggcggggaccgctacctatcaaccgacctttacaacttttaatcaatggtagattgcaacaattaatcgaatttttcggacaagtcaccaaagaagacttggagtggcattttccaccccaaacatttccggggacgccagttcaagtactttgagatcatggtcagctcttcgtctgtaacgctctcaattgactggttctttggaatgtgtagccgaagctcgcggttcaaccgttcgttggttccgcgttcatgtggcgcatacgggtgggcaaaataatgggcaattccgtaggcttcaatttccttgaagcctgcgaattccttaccgtgatcactggagattgacttgatcaagccgcgcaactcctcgttaagctctaggattgccttagtcatagctttactatcacgtcccggtaaacgacgaataatcattagtcgggacttacgatcagtaaagggtagctaggacctcacccctggtttttcctgataggatggtatcgacttcaaaatgaccaatctcttgacgcaggttagcctcgtccgggcgttggttgataaacttcgccccacgtgtgtactgaccacgaccatcgtggctctttcggtaccgcacaccgtggtctggaaggacctcgcgtttgattccaaccagcccttgtccagccagttatagagggttttgaatggcatttggagaatatgcgcgataacttcaaaactccaccgctgttcgagaatgatcccacggacgaattctcttaaattctctgttagaagagttttccgcccccggtgagttagcttcttttcgcagtcttcctgagcttgatcagcgtcatagtatcccttaggacagcgttttagttcatagttgatggttgaaggagctacaccaacttcttcagcaatttgtttttgtgagtaaccaacttaagcagcgtttggatgacagttctatccgataatgttaaaatatgactcatgggtaatggactcctattgtttatagttttgtcacttaaaataataccgggtccattgccctttttctatccaaatttttcgtctgggtagaattctatttaatcttacaatctacccaatcaaaaagaggctgaggaaatctgttttcccagcctcttatttttattcctgaatgttagacagaaaacgtggaaaataaccgcaggtctagtgcctaagcaggccgaagaacggtgcgtaccgcaccaaccgttcgtccgatcttacatacgacctgccaaggaggttatttcccactccattgattacttaacgcgggtgatccagccgtgggtgtcttctaagtcaccttcttggatcccgtaaagggtgttgtaaagcttggtcgtaaccggtccgacttctttttcggagtagaagacgtgcttttggcccttgtaagttaaggagcccaccggtgaaatcacggcggcggtccccattgcgccggcttcagcaaagtcatcgagttccttgtcaatttcgatcttacgttcaaccgggttgaggcccaggtcgtcagcgagaactaggagcgacttcttggtgatggatggcaggatcgagtcggactttggcgttacgaactgaccatccttagtgataccaaagaagttggcgccagagaattcatcgatgtacttgtgttcgcgtgggtcgaggtagaggcagtcggcaaagccagccttcttggcctcaatttctggcaggagcgagctagcgtagttcccggacgtcttggcttgaccagttccggcaccggccgcccggtcgtagttggaaaccgtgtacggggaaggagcgaggccgttgatgtaggcaccaaccggggtggcgtaaatgtggaaggtgtaggtgtcggccggggcaacccccacgatgggttgggtcccaatcaaaaatggccggatgtagagggaaccgcccgtcccgtacggtgggacaaattcctcgttggcgagaacaacttgcttaacggcctcgacgaacttgtcttccgggtagggttccatcagcattcgcttggcagagttagcgagccgcttggcgttttcttcggggcggaataagttgatgtgtccatccttggtccggtaggccttgagcccttcaaaaacctcctggccgtagtggagtacttcggcggcttccgagagggttaaagtggagctttcggtcagcgtaccaccttgccattggccatccttaaactcttcgttgaagctgtacggcaggtcgtggtattcaaagcccaggtggttccaatccaggttagcgacggtttcttttgccataaatgtgttcctcctcaatgaacggttagtcttcttggtcagcggcttccagcgactcggcaaacttttgcttgatgaagtcagcggaaacttgaagcttttgcaactcttctgcggtcaggtctaattggcactgttcgacgattccatcgcgcccgaccacggccgggtaggaaaggtagacgccgtattcctcgcggtagtttgaaaccggcagttcggttagggcgttagagagaatcgtgttaaccaggcgaacggcggccgtggccaccccgtagctggtgtacttctttccatgaaaaacaatgaagccaccttcgcgggccgccttatccaggtccaccaggtccaagcccttttggtcggcgatttgctcgattggcttccccaagacccggacggttgaccaggcggtgaactgagagttaccgtgttcaccaaggttgtagccggccacggagcgggggtcgaggttgagcttcttggcaacggcgcgcttcatcctggcggagtccaagagcgtcccggttccgatcacgtggttctttggcaagccggtaatttcttggtataaggaggtgatcacgtcgaccgggttagtgatggcgacgatgatcccgttgaagccaacttccttaagctttgtggcgacctttttgacctgaacccgggtgtagggtagttcggcaaagcggtcatcgtcggggttatcttggagcttaatgttaccaagggcggaaaccaccacgtcagcgtcggctagggcctcgtagtcgttgacgaagatattagtgtgatattccaggttagccatcgcatcttcaaagtcgacggcatcggccaccaccttttcttcgcgcggatcaattaggacgaggtcgtcggtaaacccgccggcgactaagtagtgggcgacggttgcaccaacgttccccatcccaacaacagcaacttttcgtgccatttgaacatctcctttacactgttacttaattttctaattattttttaatatatcgcgttgaaaaggaaagtgcaacgattattttagcgaagtgatggtaaaatgtttggaaaagggggacttaccatgaccaattacctcgtttctgaccttgatcacaccctattaaacgaacggggcgccctgagtccggtcacccaagcggcggttgcggccgtagccgatcgagtgatgctggcgtcggcccgccaccccgggcagatgacggttttgattgaccaactgggcttgacgggtccccaggtggccttaaacggcgccctgatttttgcgggggccagtggggagactttgagggcgcagccaatcgatgaccgggatgcccaagcggtggtggagttggtagccgaacgcttcggggaggttaacttcacctggatggacgcggcggcttggcacgttagctttgttgacgcggccgtcgagttcgatcaatgcctagttcccgttcccctagcaatggatggtttaaaaccggccggcgccctgatgttgttgatgatcgtcagcgacccggggatgtttcaaacgttggggcagttgttgaaaagcgcctttcctaagctgacgatcagcccggctggtgacgggtacctaacgatcacggcgccgggggttgataagggacgggcggttgactaccttgttagtaccggaatttcccgggcgaaggtggtggccgttggcgatgacgaaaacgacttacccttattaaaccgggccgggcacgccgccgcggttggcaatgccgcttcagtggttaaacaacgggcgcaggtcctgttgccaactaatgaagaagacggggtggcgacgttgattaaatcgtggtcttctatttaaccccttacacgagtgcggtatactaaaactattgaaataaacaccataaggagatgcttgctgtgacctggaaagatacctaccaagaatggttaaaccaagaccaattggaaccagcgctgaaagaacaactcgtagcaatggatgatgaccaagagaaagaggacgccttttatggcccgctttcctttgggacggccggaatgcggggactgatgggtcccgggattaaccggatgaacgtttacacggttcgccaggccacggccgggttggccaagttaatgaccagcttgggggaagaaacgatggcccgtggggtggccatctcttacgactcccggaataactcccgcctcttcgcccacgaagcagcccgggttttaggggcccaggggatcaagacctacatttatgacgacctgcgcccaacgccagaattgtcctttgccgtccggcacctgcacacctacgccgggatcatgatcacggctagccacaacccgaaggaatacaacggctacaagatctacggtgaagacggtggtcagatgccaccgaaggaatcggacatgatgaccggctacatccgccaaatcgaagacctctttaacatcgaattagctgacgaagaagaacttaaggcccagggcttagaggttgtaatcggcgaagaagtcgaccaagcctacctggccaacgttaagacggtcacggtcaacagcgacttggccacggaatttggtaaggacatgaagtttgtctacaccccgttgtgtgggactggccggatgctcggggaacgggccctcaagcaagcgggcttcactaactacgagctggttgaagaagaagcagcgccgaacggggacttcccgggcttaaagaacccgaacccggaatttccggaagccttcgtgcgggcaacggccctcgggaagaaagtcgacgccgatatcttaatcgcaaccgacccggatgccgaccggctgggctgtgcggttcgccaaccaaacggtgagtaccaattgttgaccgggaaccaaattgccgccgtcttgctccactacatcttggaagctaacaaacaggccggtaccctgccggacaacgcggcagccgttaagtcaatcgtttcaacgaactttgccaccaagatcgcccaaagttacggggtaacgatggtcaatgttttgaccgggtttaagtggattgctgaccaaattcaccaatacgaaaccaagcacaaccacaccttcatgtttgggtttgaagaatcctacggttacctgatcaagccgttcgttcgcgacaaggatgccatccagaccctggtcttgttggcagaagtggccgcatactaccggagccgggaaatgactttatttgacggggtgcaagaactctttaccaagtacggttacttcaaggaaaagacgatctcaacgacttacgccggggtgcaaggaccagccaagatcgctgctttgatgaagaagttccgtgaagaagcgccgcaggactttgctggggtcaagattgaagagaccgaagacttcgccaaggataccaagactttggccgacggaaccgtggaaaagctgggaatgccaaattcgaacgtcttacgctacgtcttggccgacgaaacttggatcgccatccggccgtccgggaccgagccgaagctgaagttctacattggaacggccgggttaagcaaccaggaggctaaccaaaaactggcagactttgaagcagccctaactgcgtttgcaaatgaataattttaatgagggggttggggaaacgctggtttcttccgcccctttgttaaatccactatgttacacagataatgtggtcaccaaccgcaggcctagtgtctaagcaggccaaagaacgccacgtgccatgacaaccttcgactaagcttagtcatacggcctgcattagggttggttcccactccactcaccttttagaaaagagagaatcaccatgggaatgcatgaataccttaagagcctaagcgacctggaaatgatcaaccgggcaccgggctactttaaatttgaagaacataacgtggccgcccactcctttaaggtgacccaagcggcccagatgttgggcgacattgaagagcaagctggtaacgaaatcaactggcgctccctgtacgagaaggcgcttaaccacgattacaccgagcgcttcatcggcgatattaagacgccggttaagtacgccacccccgagttgcgtacgatgttagccaaggtcgaccggtcgctaaccgagaatttcatccaatctgaaatcccggccgagttccgggcggcctacgaacggcggctaggtgagggcaaggatgagagcttggaggggcagattttatcggtggccgacaagattgacctgatgtacgaatcttttgaagagatccaaaagggcaacccggagccagtttacatggatatctaccgctccagcctggaggcgatcatgggcttttccaacctggccagcgttcagtactttttaaagaagattttgccggaactgttaaaggataacgtcgccaccaacagccaacagctagccatcatcaccacccagattattcaaaggtaacagagatgaaaaaacagactcccgttttagtgacggtaattgccaacctagccatgtttgtcgccggggcgctggtgattttaaaactgtggtggcccctggtcatcaccctggtcatctacgtggtggccgctagctaccagtttgcctggcttaattacgtccgcctttggcagcaacggatcgaagaggagaaggggcgcacccctgtcaacaaggaaaagccatctaattagacgaataaacgttcgtgtgctaaacttaacttaattgtgggcccgtggtggagttttgaccgcgggcccttgtacgctagcaacaaagggggccagacgatgatttatcgccaaccggataaagaatttcaacttgtatcggattaccaaccaaccggggaccagcccgaggccattgcggccttgaccaagggggttgaagagggtgaccacgcccaaattctgcttggggcgaccgggaccgggaagacctttacgatttccaacgtgattaaaaacgtcaaccgtccgaccctaattctctcccacaacaaaaccttggccggtcagttgtacggggaaatgaagaagtttttccctaataatgcggtggagtactttgtttcctattacgattactatcaaccggaggcctacgttccttctagcgatacctacatcgaaaaggacgcctccattaatgacgaaatcgaccagctccgccactcggcgacttcgtctttgatcgaacgcaacgacgtgattgtggtggcgtcggtgtcctcgatctttgggttgggttcgccagccgaataccaaaaccacgtcgtttccctgcgggtcggtcaagaaatccctcgtaaccggctcctgcgtgagttagttgagatccaatttgaccgtaacgacattgatttccaacgcgggcgcttccgggtccggggcgacgtggtggaaatcttcccagcctcccgggaggaaaaggcgatccgggttgagttcttcggtgacgagatcgaccggattcgcgaagttgacgccttgaccggcgaggtaatcggcgaccgggaacacgtttcgatcttcccggccacccactttttgacctccgaagacatcatggacctagccctgccggaaatcgaagccgacatgaagagccaggtcgctaagtttaccaaggaaggcaagctcttagaagcccagcgcctccaacagcgaacgacttacgatatcgaaatgatgcgggagatgggttacaccaacgggatcgaaaattattcccgttacatggaccggcgcaagcccggcgaaccccccttcaccctcttagacttcttccccaaggacttcctgttaattgtcgatgagtcacaccagacgatgccccaagtccgcggaatgtataacggtgaccgcgcccgcaaacagcagctaatcgactacgggttccgcctgcccagcgccttagataaccggccgttgaccctgaaggagtttgagggtcacgtccaccaggtcatctacatgtcggcgacgccaggcccgtacgaagaagctcaaactgaccgggtggtccaacaaattattcggccaacggggcttttggatccgaccattgaagtacgaccggtgatggggcaaatcgacgacctggttggcgagattaacaagcggatcgaaaaaaacgaacgggtcttggtcaccactttgaccaagaagatgtccgaagacttatcggattacttaaaggacctcggcttaaaggtcaagtacctgcactcagatatcaagaccttggaacgtacccaaatcattcgcgacttgcggctgggtaagtttgacgttttagtcggcatcaacctcttacgggaggggctagacataccggaagtctccttagtggccatcttggatgccgataaggaaggcttcttgcgtaacgaacgctccttgatccaaacgattgggcgggcggcccgcaacgccaacgggtccgtgattatgtatgccgacacggttaccgattcgatgagggccgccatcgacgaaaccaagcggcggcggacgatccaagaggcctacaataaggagcacggcatcacgccaaagacgatcattaagccgatccaagaggcaattaaggccgttaagccggtagaagatgagcaagccgataagggggcagaatttaccagcaaggactttgcggccctagataaagaggcccaggcccagatgatcgccgagctaaccgagcagatgaaggcggccgccaagcgcctagactttgaacaggccgctactttacgtgatacggtcatggaactgactagtcgaatgaagaagaaataggagttattgatggcaaacgaaaagattgtaattcggggtgcccgggcacataacttaaagaacattgacgtgacgatccccaagaataagttggtcgtcatcacggggctgtctggttccggcaagtcctccttagcctttgataccttatacgctgaggggcagcgccggtacgtggagagcttgtcggcttatgcgcgccagttccttggccaaatggataagccggacgtggactcaattgaagggctatcgccggcgatctcgattgatcaaaaaacgacttcccataacccccgttcaacggtggggacggtgacggaaattaacgacttcttgcgcctcttgtgggcccgggtggggacgccgctttgtcccacccacggggtaccaattgccagccaatcacctgagcaaatggttaaccagatcctagagttgccagaacggacccgcctgcaggtactggcgccggtcgtccacgaaaagcgggggacccaaaaggcagtgttagccaagatcaaaaaggacggctttgtccgggtgcaagttgacggtgaaacttacgacgtcgatgaggtgccggaactggagaagaacaagaagcactccattgacgtggtggtggaccgcattatcgtgaaagacggcgttcgttcacgcctgtttgactcctttgaagcggccttgcgcctggccgatggggtggcggtggccgacattattggcggtgagaagatccccttttccgaacactacgcctgcccgtacggtgacttctcgatgcccgaactggaaccacggttgttctccttcaacgccccgctgggtgcctgcccggtttgtgaggggctcgggagtaagttagaagttgacgtcgacctcgtggttcccgatcaaacgaagaccttaaacgagggggccttagtgccgtggaacccaatctcttctaagtactaccccagcctgttggcccagtactgcgcggccgccgggattgacatggacaccccctttgaagacttcgatgaccaaaccaagcaccagcttttgtacggtgatgacttaaccttccacttccactaccaaaatgactttggcggcattcgtgacgtcgacgtgacctttgagggggtggtcaataacgtttcccgccgctacaaggaaacgaactccgatttcactcgcgagcagatgcgtaagtacatggccgagttgccgtgcccagcctgccacggttaccggctcaacgaacaggccctagcggtgaaggtggcgggccaaaacattggtcaggtttcggaactgccgatttctgaagaaattgactttttccagcgggttcacttgtctgaacaagaccaagagattgcccggccaattctaaaggagatcctcgaccggctgacctttatgcaaaacgtgggggttgagtacttgaccctctcccggtcggcacggaccctatccgggggggaggcccagcgaattcggttggcgacccagatcggttccaacttgtctggggtcatgtacgtgctagatgaaccatcgattgggctccaccagcgcgataatgaccgcttgattaactcactgaagaagatgcgtgacctggggaacaccctgattgttgtggaacacgatgaggatacgatgcgggcggccgattacatcatcgacattggtccgggggccggcgaagacggtggtcaggtgatggcggctgggaccccgaaacagattatgcgctcacgcaagtctttgaccggtaagtacctgtcgggacgggagatgattccggtacccagcgagcgtcgatctggcaatggccacgtcttgaccctcgtgggggccaaggaaaacaacctcaaagacatcaccgttaagttcccgctggggaagtttatctgcgtcaccggggtgtctggctccggtaagtcgaccctggttaaccagatcctcaagcggatcctggcccagcaactaaaccgggccagcgacaagccagggcgttacaaggagatccgcggcttggaaaacgtggaaaaggtgatcgacatcgaccagtcaccaattgggcggacgccgcgctcgaacccggccacctacacgggggtctttgacgacatccggggcctgttcgcccaaactaatgaggccaagttacggggctacggaaagggccgcttctcctttaacgtcaaggggggacggtgtgaagcctgccacggggacggaattatcaagattgagatgaacttcttgcccgacgtctacgttccctgcgaggtttgccacggcacccgttacaactcggaaaccttggaggttgaatacaagggcaaaaacatcgctcagatcttagacatgaccgttgaagaggccctccactttttcagtgcgattcccaagattcggcgtaagcttcaaacgattcaagacgttggcctaggctacgttcacctcggccagccagccaccaccctgtccgggggggaagcccaacggatgaaactggctagtgagttgcaccgtcaatctaacgggcgttccttttacatcctcgacgaaccaacgaccgggctccacatggccgacatcaagcgcctgctagcagtgctacagcgcctagttgacgctgggaacaccgttttggtgatcgaacacgacttagacgtggtcaagtcggccgactggttgattgacctcggtcccgagggggggcaagccggtggagaaattgtcgctaccggaaccccggaagaagtggcccaggtcccagcttcttacacgggtcactacctcaaggagatgttggaccgggatgccaagtgggcggcggaacgggcctctaaaaagaagaagtaaggacctttcttgacaaaaaggggcgcgccctcctatccttgatttaacgatcacgttcggataaatcacctaatggaaaggattttagaatgcaagaaatgaaactggccaaactccagagtctaccaagcaagtactacatgctagaccttgagtttgccacccataaaaagacccgggagcacctccccttagaaattggggtggtcaagtaccaaaacgggcgcaaggtcggtaagcaattccaccgctttgtttactgggccgacgccgaggccgacgatattttgcgtggaatagattacgccaacgtcacctacaagacctacaagaagcagggacagtgggataagatcgttgccgacctcttaaactttatcgactttagcctaccgattggggggtggaacgtccacggcgatctccaggtgttgttagaggcaattaaaaaccacggtggcccgctcgttgatgagaaggcggtctgctgctttgaagttgacgagttggtcagctggttaggggaactacccaataaaccgagcctgcgtggggtagggcgtttgctgggctttgacgtctcaaatatgcaccatgccctttcagatgtcttgttaaccgcgcaggtttacgactacttagtcgccctgccggaaattgccagttggaaaaaggacccgaccaataccaagtctactaaggaggctgggcggaccaaggcgaccaagaagggaaaccgccaagtgaccaagtccgccaacgcaacgatcaacaccaattcctctaagcaggtgccgatggtaattgaccaaccggctgaccgtcacttggttgacctaagtgagcaccccgtttccttaaagaaactggcccaagatgacggtagcgtaccggtggcggtggtctttaaccccaagcaggcccggatcaccaacgatcagtccgtgattgaccaattggctaatcactaccagcatcaatttaagcgggtttcaccaaaggaagcccggctcggcttgcttttggacaccaatagtacggtgccacgggcggccagcaagaagagtgcgcaattccgttacctagaagagcaccaggtaccgattctgtcggtcgctaacctggccaaggaattaaatatcaaaaccgaaaagggaacccccgaaagtaactaggcgtaacaagaaggtgggaactcaccaaccacgtagccccaagtgaagggccacggttggttggcgcactttctgtctaacgttcgtgaatacagtcggaggccgggagaaacgatgcttccggcctccttttttgatacgccgggtagcgttgctaggcatgacacgcccggtgtgttacaatagacgggtgtttgaaaagacgggagggtttgataatggcggaacaattagaagtggtcatcatcacgggaatgagcggggccggaaagacggtggccgtccagtcctttgaagacttgggctactttgtcattgacaacatgattcctagcgtggccaccaagttcgttgacgcggttaagcagtccggtgaaattacccggatggcaatggtgatggactcccggtcacggggattttacgatcaggtggtgccgtgcgtagcgcaactacgggggcgttctgatcttacgttacggctcttatttttggaggctacggacgaggagctagtttcgcgttataaagaatcgcgccgggcccaccccttgagtcaccaagatggtgttttaccaggcatcatgcgggagcgccagctgttaaatgacctgaagtcgcaagcggatctggtggttgatacgaccaccctgacgccccgccagcttaagcaacgaattacggaacgtttttcaccggacgaggcccgctcgttttacgttaacgtgatgtcctttggctttaagtacgggcttcccctggacgctgacttggtgattgacgtccggtttttacctaacccgtattacattccagacctaaagcaccagacggggaacgatccggcggtccaagcttacgtaatggataatccgctggcccaaaacttctaccaacacttgtattctctaattgaagtcgccttgccgggatacatcaaggagggcaagagtagtttgaaaattgccattggatgtacggggggccaacaccggtcagtaacgattgctaaccggctggccgctgacctgaagaataaccaatacccagttcacgtccatcaccgtgacgtggacaaggccaactaacagaaagaaggagtcgttttgatgcatcatctcccgaaggttgtggtgattggtggcgggaccggcctgccaatcattttacgcggcctaagagaccataatgttgatattactgccattgtgaccgttgctgacgacgggggctcatcggggatcctgcgtgattacgtgaacgtggttccccctggcgacattcgcaatgccttggtggccttggcggaaatgccccggattgaaaaggatattttccagtaccgcttccggagtaccgaccaatttttggcggggcacgcgatcggcaatttaatcatctcggccttggcagaaatgcggggcgggatttttgaggccgtccaagaactagggatgatgatgaaaatccatggtcacatctacccggttgccaacgaaccgctgactttaaacgcggcctttgccgatggccgggtcattcggggcgagtcggagattacggccgcccacgggcaaatcgaccacgtttgggttagtgacggggaacaccaccagccagaagcggtgccggaggtaatcgaggccattatggacgccgatcaaatcgtcttggggccggggagtttgttcacctcgatcctgccgaacctgatgatcgaaaacgttgggagggcggtttgtgaaaccaaggcagaggtggtctacatttgcaacatcatgacccaaaagggggagaccgatcacttcaccgatgccgaccacgtccgggttttaaataagcacctgggaaagaactttgtcgataccgtcttggtcaacattcagccggtgccaaacgactacattgactttaaggagtggaatgagatttcacagccggttacccatgatttccgtaccctgcgggaaatggggtgccgggtgatttctagtaacttcttgcgcttgcgcgataacggtgccttccatgatcgcgacaaggtcgtcgaagagctgatcaaccggctccatgacgttcattactaaactgaaggggagattccatgtcttacgctagcgaagtgaagaaagaactcaccgggatcacggtacacgaaaaaaacgcccgggccgaattgatggccctgatccggatgaacggctccattgggctggctaaccatgccatgattttaaacgtccagaccgaaagtccggccatcgcccggcggatctattcactgattaagcaactttacaaggtagaaagtgatattctggtccgcaagaaaatgaaactcaaaaagaataacacctacgtggttcgcttacgccaccacgtccaggaaatcttgggggacctggccattttggacggttttcaaatcaaggaacgggttcccttggacttgttgaccgacgacttgatgatcaggtcatacttgcggggggccttcttggcgggcggttccgttaataacccggagacatcgcgctaccacctcgagatctattctttgtatgaagagcacaacgagatgatcgctgaaatgatcaaccgctatgacctaaacgcccgcaccaccaaccggcgcagtggctacattgtctacttaaaggaagccgaaaagatcgcgaacttcttacagttgattggggcaaccacttcaatgctcgaatttgaaaacatccggattgtccgcgacatgcgtaattcggtcaaccggctggttaattgtgagaacgccaatatggataaggtggccaatgccgccaatcgccaggtggaaaatattatgctgattgaggcgacggtggggctaagtagcctccctgaaaagctacgtgccatcgccgaaactaggttggctcaccaggaagtaagtctaaaggaactggggacgttggtacccgggggcccgatttcaaagtcgggggtcaatcaccggctccgcaagctaaatgcctacgccgacgaattgcggcagggcaaggcaatctaaataataaacaagaggctgcgaggaatttctcgcagcctcttgttgtctgtcaaccaccactgactaaagtcagtggcttgtgagccgaatatcatcacggatttcgaaccacaatttgcgtagatagggacaacttatttgaccaactgaaattgtaatcaaacagcggtcgtctaattaccaacgccttttatgtccccaggttgccatagggacagataagctaggctagtttagctattcccttatcaagaatgtttttagctgcgttccagtcacgaatatggtgaataccacagttaggacaagtccagtttctatcatctaatgttagtttgtccgtcccattagtgcccattacaaaaccacaatcgcgacatgtttgggtagtatttcttgggttgattgtgataaattgacgcccataaagctttgctttataagccaacatgccaagaaatgttcgccagccaacgtcagaaatactaagtgccaaagcatgatttttaagcaaattcttgctacgcaactcctcggctactactaaatcgtggttcttgattaatgcggtagaaatttgttggagaaaattatgcctttggttcattaccttggcatggagtttagcgactaacaagcgctgtttttgataatttttactatctcgtaaagaacgatgttctttttttgcacgttgttgccgtctagataaaatgcgctgttctttggctaatttgcctttaatagtgcggtaatatcgtggattaggaactatgttgccttcactgtcggttaagaagttatcagtattaagatcaattccaacatgtccatgagtagctttggacactttaacaaaagattcatctgaagctaactgcattgataaaaagaagcgatccgctgaatctttagtcaacgtcacggtaccaattctagtctcgcatattcttttcaaaagccgtgcttgcgaaccggcaacacgtaacagtcctattttaggtactttgacatgactattatctagaaaacagactgtaccgttagttagcaacgcagttttttgccccgggtattgacaattggtttgataccgccagtgataactctttcgatgaaatttgggaacaccagtggcgtgaaccttccgaaaagcattccaagcttttcgatagttctgaatggcattagctttcgtcaaactatcaattcgtttatcttctaagaattgatagtgattagacatttgcttagcgttttggcgcatagttagttgcttaatacgatcctgaactatgtcaatcggtagcttaactctgcgaagctgcatcagttccttattgatcgcaaccatttcgttatagataaagcgactagcgtcactgttgattttaatcaactgcttttgttggtcactaggatagcagcgcatttttaggccataatgatgtttcatttttgccattgacttcattttatttcacctcctttattgatatgataacattatatcatgatgtcaatgtattaacaaaggagagcatattatgactaaagaaaaaatcaaagatgccatttatactcgtcgttatatctataatttccattatcatttgatctgggtaactaagtatcgcaatcagacttttacaaccgaggtcttatctaacgaaatgaaagctatcttgcagcaagttgcagatgacaatgacatcgtaatcgaaaagatggaagtcatgccggatcacattcatatgctgatcagttttccaccaagcaaagctccggctagtgccattaaggcgctcaaaggacgtagtgcctatatttttttacagaatcatccagaaatacgatgtagccaatattggggcggtcatctttggtcgccgagttactatatgagtacattgggcaatatgagcaaagaagttgtcgagaaatatatcaatgaccaaaaatatacagaaacaaacaaaaagccccataaaggggctcaatagtggcctatccatcccatgactaaagtcacgggattcccggctaatattaattaaatttagccccagaataaaagaggggcaccccgctgtcaatcaaaaaaggcaccaagcagaaataaattctgcctagtgcctagatgcgggggttacttcagattgtttgaatccataaccccatccaacaggccgtaatccacggcttcttgggcggttaagtagtgatcccgttcagtatcttgttcaacttgctcgaagctttgcccggagttcttagcaagaatttcgttgatcatcttgcgggtcttcaggatttcttcggcggcaatttggatttcggtttgttgaccttgggcaccaccggatggttggtgaatcatcacggttgagtgtggaagaccgaaccgcttccccttggtcccggaggaaaccaggacggatgccattgaagcagccattccgatcacgatcgtttgaacgtcagacttgatgaagttcatcgtgtcgtagattgccatcccagaggtaaccaccccaccaggggagttgatgtataagtagatgtccttggtggaatcttgggcgtccaagaagagcagttgggcaacaattgagtttgccatgttgtcttcaatcggaccagataacatgatgatccggtcctttaaaagacgggagtaaatgtcataagcgcgttcgccacgggacgattgctcaatgacggttggtactaagttcattcagttggcctccttaattagcactagttagtactgtttgctaacttatggggatagtctactctataggtcaaaaaaggtcaaatcatttacccactcgttggcaaaagtttttcaccccattggcatggaccaggcccaattgggggcgttttcgcaatctgtcacaccgttaacatattgagagaattatttttaaattaacgtgaacggcaagaagtaacgaggtggggccatcctcgattagttgacacttggtgtgaaaaaagtccgcgagtaaagtactctcacggactcatgctagctttttaaatgttaggtagaaaaaaggtggagatgatcagcatcttaaccagagttcggccatagaaggcggtgctccccccgggacagttggcgagccagatgattagtgattagtcatccaggtcttggcataaaagatctaattcagcgctggcgctttcggcagccaattgactcatttctgctttgtcatcgccgtttttgtaaacgtctaaggctgctaacatccgttcgtgtttcgtcatggtctaggtcctccataattatttaattggtttatgttttaaattggttaatgacgagggaatacccgtcgttaattgacaatacctatcatattcctcaatggtctagttggcaagtccttttaatgaccaaatttaaacaaccggttgatataaattggtctagatgctcgctttaggggaggaaaattaatttaaaaaaggggcttgtcaaaaaggcgctgaatgtgtattattatatacgttgcttgataacaaagcagcaaggcaaagaaatgcgccaaaaggtagcgcgcccttagtgtaatggatcgcacgcgagattccggttctcgagatcggggttcgactccccgggggcgcattaaaaacgaatattatgccccagtggcggaactggcagacgcgcaacgttcaggtcgttgtatgggtaaccatgtacaggttcgaatcctgtttggggcactaagttttattgtcgtcattttcaggggtgtttaaaaccttgatatgacggcattttttattcttactaaacgttagtaaacatagttttaaatagaaactgtggtaaaaatcattttcataaggtcgtgcatttgggctatctgatatagatagctcttttttaaaggctctttgtcaaatcctgttgatgggtcattttaggcggcggccggtgcttacacctggcgccgccttttttcagcttccgttcccatttgatgcaatcggatccgggcgatgaaatgaccaaagttagtaaagccatatgccgtccgttgaattaacttgatcatgcggttgatcccctcaacccgaccgtttgagtacggtaatacggttgcgttgtacactccttcgctgttcttacggagggtcttaagaaccgtttggaacggcgctggcatgtcccatttggtgaacaagaggtccattaattggtcaacatcgtgctcttcaagagcggtcatggcgccctgtaagagttcataaccggccgctaactggggatcaaggtccaggccaattcccacccgttcggccatcgttaccttttgtcgtaagtggcgatcatagtactccttagtgtagttaagcgatgtgcttttaagtaagtacagtcgccacgaattcttcaatgcccgatactcacgcgtattagggtcgaattgcttcattactgcgacccggacttggttaaacgcccgcgtaagcattgaaacgatgtggaatcgatccacaaccagctttgcgtttgggaagtagcggcgcacaaggccttgatagtaactgtttaagtctgtcgagactgatttgactcgtttgcgctcttttagcgagaatcgatcaaagtaatgcgtaatactactcttaagccgatcagggagaatttggtagatttgtgaggtatcattatcaacgataataaagcaatacttcccctgcggaccacggaactcatcaatggcaatattagtgggtaaagtgcgactattaaaacgaaggagcgcttgatcactgtctaggagtcggccaatggtactaggtgacacaccggtaaacttagacacgtccttttgagagacattactttcaagcatcgtaagtgccttgtgtttaactgctttggcaatggaacagtatttatcaacgacgttggtcttcgccatgaacgaatcttggcaattcttacatctcaggcgttgcttaccgatccgcaacatagtgggacaactttcgttaattgagaggtacttaatggtttggtaagaatggccattcttaatgaaggtatccgcaaagccgcaatgtgggcaccgatccaatttaagcgagaccgtcccaatgaagacctgcgtctcccatccgtcattattttcaaagacaacgtctgtgaaatgaaaattggggtctttaatttgaaggatatttttaatataatcagtcataaggtcacacctcttactttctggaatttgcgtggtagttaatgatcagaattttaaggttggtggggcctttttttgtgccctcaaaaccaaaaaatcctgtcaacgaatcaccactatggtaatccatcaacaagatttagtgtagagcctaaattcgccggaaataaaaaatccccgccgcccaaatgggggaggggatcataattgaaattacttttcgtcagcaggtgcttccttagcccacttacggatagcttcaatcttcttttcttttaaagcccgcttgtacttcggagcaattggacgccggccttgaacgccgtgtggatgtgctttgcgcatggttcatgcctcctttatctctctcgtaaatatttcaacattccgattataacgaaagtcaccttaaatagcaaccgtcaatcgccaacggaaaatctaggcggcatgattggacaagcacaagtgaaatgggtacaatgttgtttatattggtggtacccaatttgggtgaactttgttaaaaaatgcacgacgatggctgtattttttggctaatggtgatacacttaatgggtacatgaattattttcctaaaggaggaaattacagtatgactgtaaagattggtattaatggttttggccggattggtcgtttggctttccgtcggattcacgaactcaactctgacgaaatcgaagttgttgcaatcaacgacttgacgacgccgtccatgctggcttacttactgaagtacgactctacgcacggcaagttccctggtgaagtttctgcttacgaagaagggatcattgttgacggtaagaagtacccagtttacgcagaacgcgacgctaagaacattccgtgggttgcaaacgacggggttgactttgtcctcgaatgtactggtttctacacttctgctgaaaagtcccaagcacacctggatgctggtgctaagcgggttctgatctccgctcctgctggtaacattcctactgttgttcctggggttaacctggacacgctgaaggctgacgacaagatcgtttctgcaggttcctgcaccacttcttgcctggccccaatggcttacttcctgaacaaggaattcggtctcaaggctggtacgatgacgaccatccacgccttcacttccacgcaagctatcctcgatggtcctcgtggtaagaagatgcgtaacaaccgtactgcaagcacgaacaccattccgcactcttctggtgctgccaaggccattggtctggttatcccagaactgaacggtaagctttctggtcacgctcaacgtgttggtgttgttgacggttccctgacggaacttgtttccatcatggacaagcacgttacggttgacgaaatcaacgccgctatgaagaaggctacggaaggtaacgacgcctttggttacactgaagacccaatcgtttcctccgacatcattggctccacttacggttctgtctttgacccatctcaaaccgaaatcatggaagccgacgatggttcccaattagttaagacggttgcttggtacgacaacgaatacggtttcaccagcaacatgatccgcaccctgatccactttgcaagcctttaattgcaagctgaattaaggtgatcaaaaaggcgggaggaggcgactcccccgtcttttcttttaaataaggaggaagatttcatggctaaattaacggttgaagatttagacttggccggcaagaaggtcttaatgcgcgttgacttcaacgtgccgattaaggatggtgttgttggcgacgacaaccggattgtggctgctttgccaaccatcaagtacgtattggaccaccaggggaaggcaattctcttctcccacctgggccggatcaagaaggaagacgacaagccgggtctgtccatgcgtccggtggcagaacgcctttctaacctgctgaacatgccggtaacctttgtaccggttacggaaggtccacaattagaagacgccatcgccaagatggaagacggccaagtactggtggttcaaaacacccgttacgaagacgttaaggacggcgaatatgttaagcgcgaatctggtaacgatccagaattgggtaagtactgggcatccttgggtgacctcttcatcaacgatgccttcgggactgctcaccgtaagcacgcctccaacgtggggattgcttccaacatgccaggcaaggcagcggcgggcttcctgatggaaaaggaaatcaagttcttaggtgacgccgttaccaacccagtacgcccatttgttgccatcttgggtggtgccaaggtttccgacaagatcggggttatcaacaacctgctcgacaaggctgataaggtcattgtcggtggggggatgacttacaccttctacgctgccaagggcatcaagatcgggaactccctggttgaagaagacaagattgacgttgctaaggaaatcttggaaaaggctggcgacaagttagtcttaccagtggataacgtagttgccgacaagtttgccaacgacgctaacaccaaggtggttgaaggcgacatcgatgacggctggatggccttagacattggtccaaagtcaatcgaagaatttaagaaggtgctggcagacgctaagaccgttgtttggaacggcccaatgggtgtctttgaaatgagtaactttgccaagggaaccttggaagttggtcaattcttggggacgcttgaaggcgcaacgacgatcgttggtgggggtgactccacggcggccgctaagcaactgggcatttctgacaagttaactcacatctccactggtgggggagcttcattggcctacctggaaggggacgttcttccggggattgctgccatttctgataagtaaacttgaaaggggttggaaagaaaaagtttcccaccccttttttgtttttttgtggaatacagagtaggttgaattccatgttcttttttacgtgggggtgattgaatgcgaaaaccattgattgtcggcaattggaagatgtataagacaattacggaagcggtcgattacgttgaccaaatcaaagacgccctgccggatccggaacaagaagaagtggagctggcggtgccaaccctctttttggagtcgctcgtcgaacacacccgggggaccaatttaaagattgtagccgaaaactgcttttaccaagacgaaggggcctttactggtgagaccagccccttggccctgcatgaattaggaattaagcacgtcatcatcggccattcagagcggcgccgcttgttttatgaagacgacgccacgattaacaaaaaggtccatgctgccttgagcgccgggatttgcccgattttgtgcgtcgatgaaacgatgaaacgcaagcaggagcacgatcggattgtctgggtggtcagccaagtcattgccggcctccaaggggtcaaagaaagcgagctttcgcgggtgacgatcgcctatgaaccaagctgggcaattggtagtggtaacgaggcggccaccccgcaagaagccaatgaggggtgttacctgattcgccaaacgattgcccacctctacaacgatgaagttgccaaccaagtacggatcctatacgggggtagcgttaatttgtctaacatcaagaccttaatgcaaaaagacgatattgacggggttttgattggacgggctagtttggacgccaccacttttttagagatggttaactaccaacgctttggtcactgatggactggttaaatttcccaggaaattagcgatctgacttgttttaaactgatcaaaataatagaatggaaggcggaattgctttccaaataaaatcaagaggagagagtcatctaatgtcacttattacagatatttacgcccgtgaagtccttgattcacgtggaaacccaaccgttgaagcagaagtctacaccgaagctggtggtgttgggcgggggatcgtcccgtccggtgcttcaactggtgaacacgaagccgttgaacttcgtgacggtgacaaggaccgcttcggtggcaagggtgttttaaaggccgttgccaacgttaacaacgttattgctaaggaaatcgtcgggatggaagttacggaccaaatcgcgattgacaaggcaatgattgccctcgacgggacgccaaacaagggtaagttaggggctaacgccatcctggccgtttccttggcaaccgcacgggctgctgcagatgaactgcaagttcctctttacaactacttgggcggctttaacgcacacgtaatgccaacgccaatgatgaacgtcatcaatggtggggcccactctgacaacaaggtggacttccaagaattcatgatcatgccggttggtgccccaaccgttcgcgaagccatccggatgggttccgaaactttccacgccttaaagaaggccttggaagcagatggcaaggttacttccgttggtgacgaaggtgggtttgccccagacttcgctaacaacgaagaaccgttcgaatacctgatcaaggccatcgaagctgccggctacaagcctggtaaggacgttgcgattgcctttgacgtggctgcttctgaactttggaacgacgaagacaagaagtacaagcttcactggtccactggtgaagaatacaccaccgaagaatggatcgaatacctttccgacatcatcgctaagtacccggttgtttctgttgaagacccgatcgacgaaaacaactgggatgactgggtaacgttgactaacaagcttggcaagaaggttcaattggttggtgacgacttcttcgttactaacaccgactaccttgctaaggggatcaagatgggcgctgccaactcgatcctgatcaagctgaaccaaatcggtactctgacggaaaccgttgaagccatcgaaatggctaaggaagctggttacacggccatcgtttcccaccgttctggtgaaactgaagacacgacgatcgctgacttggtggttgctactaacgccggccaaatcaagactggttccatgagccggaccgaccgtcttgctaagtacaaccaattaatgcggattgaagacaaccttggcgacgttgctaagtacaagggaatccgttccttctacaaccttagtgaacaagctaagcaagacatcgaaaaccgttaatttggttgattaaaaagagaccggaagaaaccctgttttcttccggccttttttaatttctggtgataatttgatgagacccgcttattgccccctcgggacggatcgcctataatgaaaaatagttgttttggcgctttgccatcgtcaagggggcacggtccccctttaacttagagaggaattgaaaataatgaaacagcaatcaagtggggcgcccgaactgcggcgttcgatgacagctggtcaaatggagatgatctccttagggggagccatcggggttggtttgttcatggggtcgacgtcgacgattaagtggacgggaccatcggtgattttagcttacgccttcgttggtttgattctctacattgtcatgcgggccctgggagaaatgatttacgttaacccggggaccggatcctttgccgattacgctaccgaatacgttcacccaattgccggttacttagctaagtgggccaacgtctttgaatacatcgtcgtcgggatgtcggaagtggtggccgccacggaatacctgcagtactggtggccacacaccaagccctgggcggctgggttggtcatcatcgccttcttggccctcgctaacttagccagcgccaaggcttacgggtcattagagttttggtttgcgatgatcaaggtaatcaccattatcctaatgatccttttgggctttatggttatcttctttggctttggtaacggcgggcaccccaccggcttttccaacctgtggagccacggcgggttctttaccggcggcatttcgggcttcttcttttcgatgtcaatcatcgtcggttcctacgaggggattgagttgctgggaatttcggccggggaagtagctaacccacaacaggcgattgttaagtcggtcaagtcagtcctcttcaggatcctgatcttctacgtcggggcgatctttgtgattgtcaccatctacccgtggaaccacctaagtgcggtggggtcgccgtttgtttccaccttcgccaaggtgggcatcaccgcggctgcctctttgattaacttcgtggtcctgacggccgccctttccggggccaactcggggatctattcttcaagccggatgctctttaaattggctcacgagggcgatgcgcctaagatttttggccgcttgtccaagcacgtggttccggacatggcgatcctggggatttctggggggattttacttggcttcattgccgacattttcgcaacggtcttttcaaagacgaccaccgatatgttcgtgattgtcttctcgtcttccgttttaccggggatgatcccgtggtttgtgatcctcttggctgagttgcgcttccgcaagcacaacccgtccctaatgaaggatcatcccttcaaattacctttgtaccccctatctaattacttcgcctttgccatgctggtggtgattgtggtcttcatgttcgttaacccagatacccggatttcagtgattgccgggacggtcgtcttggtggtggccgttttagcctacctgatccggtaccggggcaacttgcgaaaagaaaattagcttaaacaggtggcgacgctttcagtcctaagcgccgccctttttttgtgctaaaataatttggtaacttacaagggggttctggagtagtgttcagatttaaatttttaaagtatagcaacgcccggtcggtgggacgggcaattgtgattggggtggccgttgggttagtggcctcggtctttcggttggcgattcaagacgtcttggtcctcaccaagctggcctttttgttcttccaccagcagccgctatggctattggcgtgggtagcggtaaccgtcccgttagcccttttcttggggcggatggcccaaaagaaccccaacattaagggctcggggattccgcaagtcgaaggtcagttaacgggccagttcgacgagcaatggtggccagtcttgtggcgcaagttctttgggggcatcctttccatcggtcccggtctcttcttgggacgggaaggaccgtcaattcaagtcggggccacggttggccaaggcatcgtcgaggggcggggaaagaagaaactgaccgccattgagcgtcgggtggggatcgcctccggagcggctgctgggctttcggcggccttcaacgccccgatcgcctcctcaatgtttgtcttagaagaggtttaccataacttctccccgttagtatggctatcggtgtttatttcctcgatcagtgccaactttgtgtcgatgcaattctttggcctcaagccggatttagacctgccccacgaaatgtatttcccggtcaatcagtacgggtacctattgttattagggctcttcttggggattttagggcggctgtatcagtacgtgatcctacggctagggacgtggagccgcaaggtaacgtggtttaagcccgcttggtacccggtgatcccattcttgttggtgattccaattgcttggtggtggccaaacacgctggggggcggtaacgggttgattattagtttgaccaacctgccgacctcggtgagcctctttttgtggttgtttgtcctccggtttgtcttctccatgatttcctacggttctgaattgcccggggggattttcttgccgattttgaccttgggagccgttctcggcgggctgtactgcgtcattttgattcacctgggcctaattccggcgcgctttttagccaactacgtgatttacgccatggccggctactttgcctgcatttccaaggcgccctttacggcgatcctgttgattacggaaatggtgggttccctagcccacctcatgccgttagcggtggtggcagtggtggcctacctagtcgtggacgtcttaggcggtgctcccgtctacacggccatgtttgaaagcttcattcatcgtcaaccacaccagtccctggaggggattacgcagatgacgacgaccatctacgccgggaccgcccttgacggcgccttagttaaagactacccgtggccaccatcctgtttgattttaatggtttaccggggcgaagaagaaatcgttccccacggtgatacccgcctccaggtcggtgacaccctagtaatccagctaaccggggccagtcacctcaagtcccaacaagcgatcattagcggtgcccaccaggtgattgattagcaatttaggcttttctatgttaaactctaagggttatagtgtgagcagataggaggaagatcgtggaaaatacgttaatgaccctgtttttgatcgattgcgtggtcatgatcgcgtgcgtgatgatgcagccggccaaaaacgataacgattcgatgtctgctttgaccgggggaagtggcgacctcttctcccggcggaaggcgcggggcttcgaagccgttatgcaaatcgtaactgtcattgtgggaatcattttctttgttcttgctttggcgctggtttacgtttcgtcacattagtagtgagcgcctccgtttaacgggggctttttttgaacgcgaaaggaataagatgacagatttaaagacacaaatactagactacctcacggaaaacgcggccctgagtttctcggccgaaaagttggcccgggtgctttcaatgaccagtgcggacgaattcacccccctggtgcaggccctcgttcaattagagcgggaaggaaaagtggaagtgacggatgatggtgaatttaagctggttccccaggtaaaggaattcactggcgtttttcaccgtaaccccaagggctttggctttgtttcctatgacccggaaatgccagatattttcattaacccggaccacacgatgtatgccctaaccggtgatgaagtggccgttaagatcttacaagcgggcgatccaacccgcgaccagaggccggaaggggagatcacgaagatcattacccgctcctacgaccacgtggtgggggaatttaagaacatgacgatgggtaacttcatcggtgaagtgattttaaaggataaaaagctggggagcctccgcttttacgtgaccggcgatgggattcacccgcaggataatgaagtggtcaccgcaagcattgcgacctacccaagcgaagacgctccggaggtgatgactgggccggccctggaagtgatcggggataaggatgaacccggcgtcgacattctttcggtggtgtacgcccacgacgttccccacgaattcccaaaggaagttttggaccaagccaaccaaatcccgttgaccgtccaaccagaagaaaaggcggggcgcccggatttaactgaccaacccttggtaacgattgattcaattgagtctaaggacttagacgacgccgtggtggcttggaagctcgataacggcaactaccacttgggggtccacatcgccgacgtttcccactacgttcaaccgggaacgccactggatgaagaggccttcaagcgggggacgtcggtttatttgaccgaccgggtaattccaatgttgccgcggcgcctttccaacgggatttgttcccttaacccgggtgaagaacggttagccatgtcgtgtgaaatggaaattgacccccaaggaaacatcgtgagccacgagatcttcccgtcggtgattcgttcgcacgcccggatgacctataagggtgtcaacgccattttagaggcccacgatgaaaagacccgccaggaatataaggaactggtgccgatgtttgaaacgatggccgacttgcaccggatcttgctcaagcaccgccaccaacggggggcaattgacttcgaagccccggaagcgaagatcatcgtcgacgagaatggtcacccaaccgacatccaattacgcgaccgcgggctgtcggaacggatgatcgaatccttcatgctggcggctaacgaaacggtggccaagcactacgatttgatgcacgtaccattcctctaccggatccacgaacacccggataccgaacggattaaaaactttgctgaattcctctccgttttcgggattaacatgccgggggacctcgccaacgttgagccaaagatgttgcaaaaggtgcttaagcaagttgccggcacgccagaggaacaaatggtccaaacgatgatgctgcgcagtatgcaacaggccaagtactccgaagatgagctaagccactttgggctgggggcccagtactacacccactttacgtcgccgattcgtcgttacccggatacgaccgttcaccgcttgatcaagtggtacaaggaaaacgggactaccgaagaggccaaggccaagtaccgggatcgcctagcggaaattgctgaacacacctcagtgacggaacggcgggggattgataccgaacgcgacgtcgattcgatgaaaaaggctgagtttatggaggaccacgtgggcgagacctttgacgccgttgtctcttccgtaatgaagtttggcctcttcgttgccttagagaatacggttgaaggtttgattcatatctcggtgatgaacgatgactactacgagtacatcgaaaagcatatggccttggtcggccgggaccaccaccacatcttccagattggtcaaccagtaaaggttaagctattgcgggttgataaggatcaacgcgaagttgacttcgagctggtgaacgccgatgaagcgccgctgactaagctgcgggcaccacggcaaaatgaccgccgcaacggtcgtggtcgcggcaacggtaatggacggcgcaataataacgggcgccgtcacttctccgatgaccacgatcgtgataacgggagtcgtaacaccacccagatcaaccgggggcaaactcgtcaccgtggcgaccgggataataatggcgaccgcaatcgtcgccgcaacggtaacagacaaaaccgccgccactagactgcaaaggagggaacagaatggcgaaaaagaaccaccaggggctcgacgccaacctgattgcccaaaataaaaaggctcgtcatgactacacggttaccgacacctttgaagccgggctcgttttaaccgggaccgaaatcaagtcggtgcgtgcacggcgggtcaccctaaaggatggctacgcccaatttcataatggtgaactctggttaatgaacgtccacattgccgaattcgcgggtggtaacatctttaaccacgacccgttacgtaaccggaagctcttattgcacaaaaaggagctcaagaagttacaaggcgaattaacggccaagggggttaccctcgtaccgttaaaaatgtacttgaaacacggctacgccaaggtgctcttgggccttgctcaagggaagcacgagtacgataagcgtaacgccattaaaaagcgtgagcaggaccgccagattgatcgggtcatgaagcattactaataaaagccaaaagcccaaccgccgaagttatcggcggttgggctttgtaattggactggtggttactagtggggacagtccccggagcgggtggggatcatcgaccctgcgggggtgccaggtaaccgctagttcgtgatcgggacggtgggcccagtggtttaggatggtggccactaaaatggcgaggggttcttcgtcttggtcggcaatgtgaactgcttggtagagccccccggtgtcttcaaggggactagttgaaaagaccagccggttcccttgatagacccggtaacggtcagagaggggggagccgaccaccatccagttgagcccccggatgtagatgacctggcgtacaaaccctagcgatttagcgatcacgccaacccgttggcggttttggtagaggacaaatttgggccacagccctagcgtaacctgcttcacctcagcgagcaggctcccttgcatggtatacaaggaaagaacgtcttggcgcagcccccacttaccggtaagcaagtaacatgcattattgaattcatcgtgaacgatggtggttgcctgacgttgaccaccgtgctcacgtaggtatagggtgcgcaccaaaatccctcccttaaagattagctatctgtattctaacaggaactgcgcttaatttcacgaatcaacaacgaaaacggtttcgttcaaggctactcccgcttgggtgagtgtgctaaaatgtttacgaggtggcagaagtgaaacagttaatcaacaatgattggtggccggtgttaaaaccacagtttgaaacggccaactaccagcaattgcataatttcttggtggatgaatatggccaccagcaggtctaccccgagatgcaccacatctttgaggcctttaattggacccccttttcgaaggtcaaagtggttattttggggcaggacccgtatcacggaccggggcaggcccacgggtgttccttttcggttttaccgggagtggcggtaccgccgtccttgcagaatatttataaggaactccaagccgatttggggtgcccgcccgtcaagcatggctacctcaggtcctgggccgagcagggtgttttactgctaaactcggttctgacggtgcgggctggccaggcttactcccaccaagggcacggctgggaacagctaaccgacgcggcgatcgtcgccctgtctaaacggccgaccccggtggtcttcatcttatgggggcgggcggcccgggataagaagcgtttgattgacctaaagcgcaacttcgtggtggaatcggcgcacccgagtcccctgtcggcctaccggggcttctttggttcgcggccgttttcaaagaccaatcagtttttggagatgaccggccaagccccaattaactggcaactgccgtcgactgtcgaccacctgtagtatttggtacatttagaacggaggaacatcgaatggacatttttgaaaagttagctgaccaactgcgcggccaagataagacgatcgttttcccggaaggtgaggacccacgtgtgttaggggcagcaattcgcctgaagaaggatcaattggttgaaccagtggtacttggtaaccaagaggccgttgaaaaggtcgctggggaaaatgggttcgacctgactggcctgcaaattcttgatccggcaacttacccagccgaagacaagcaagcaatgcacgatgccctattggaacgccgaaacgggaagaacacaccggaacaagtggaccaaatgctggaagacatttcctactttgctacgatgctagtttacatgggtaaggttgatggaatggtttccggggcggttcacgcaactggggataccgttcgcccagcccttcaaattatcaagactaagccaggttcccaccggatttccggtgccttcatcatgcaaaagggtgaggaacgttacgtctttgctgattgtgccatcaacattgaattagacgcgccaacgatggccgaggtggctagccaatccgctgaaacggccaagctgtttgggatcgaccctaaggtagccatgttaagcttctccaccaagggctcagccaagggggacatggttaccaaggtcgctgaagccactaagctagccaaggaagccaacccggaccttgctatcgatggggaactgcaatttgacgctgccttcgttccatcagttggggaactaaaggcccctggttcagacgttgctggccacgctaacgtattcatcttcccgagtctagaagccgggaacattggctacaagattgcccaacggttcggcggatttgaagccatcggtccagttttgcaaggattaaacgccccggtggctgacctctcccggggaacggacgaagaagcagtttacaaggtggccttgattacggccgcccaggcactttaaggatcaccatgaagcaatttacctttaatactccagaacaaacaaaagaactcggccaaataatcgcgtcggggttgcgggccggggacgtgctcgttttaaacggcgacctcggggccgggaaaaccactttcaccaaggggctggccaagggcttaggcatcgatgaggtgattaaaagccccacctttaccattattcgtgaataccaaggggggcggctaccgctttaccacatggacgtctaccggctggaaaacggcggggcagaggacctgggtttggatgaatactttgacggtgatggggttagcgtggtagagtgggcccaatttgcggctgacgaattaccagctgattacctagccctaacctttacgcgcaccgatcaagataaccaacggaaagtacagttagacccccatggcgaacactttacttccctagtggaggcgttgtaatggcagacgaaacggtatccctacgtgaagctaagccgaccgatgcggccgcactgttagccctgttaacacagttacaaacggaaaccaacgcgattgtctacagtaacctagcgaacatgacggtcgaacgtgaggcccaaaaccttgcccagatcgcccgctctaacactgggatcattctggtggccacttaccaaggtaagttaatcggcttggccaccgtgatgcgcatagaaggagacgcgaacgccggcgaactaggcttagcggtcctcaaggattactggcacaacggaattggctcattgctacttgacgaggccctctattggtttgtaaattttgcccagctagatcacctggtgctggacgtttacaagagtaataaccgggctcgccggctttatcaacactacggctttgtcgaggtggcggagtgcaccatcaaggacagtgatggccatgaccagccggctgtttcaatggagtatcaaggaattgaggaattgtgattccgtaaacgctaagaggctgggagaaaaccgtgttttctcccagcctcttgctgtatttgtaagtgttaaactgaagccgacccttaccctagcttagtcgtccacgtcacctaattacgacctttcttagcggttgaccacccgaacgaagggtctaagtggcgccgtaccaaagtgattagcctggtacaaaaggatgttggcgcaggcgtgggcgtcgtctaaggcattatggtggtgatgtaggtcgatattgagctggtcacagattgtattgagcttgtggttgggaaacgccgggaacagctggcggctggtctttaaggtgtctagcgtctggtagaccgggggctcaatttcaaagtggagcagggtatttttcaaaacgctgttgtcaaaggtggcgttgtgggcaatcacgagcttatcgggcgtgaagaattcttggatgtgctcccacacctccggaaaggtaggggcgtcttttacatcgcgctcgtggatcccgtgaacctgggtgttacgccaaaaaaagggcgtttgcgggttaattaaggtataaaactcatcttggatctgactgttacgaacgatggtgatagccagtgaacaagccgaaaaacgtttcgcactagccgtttcaaagtccatggcgataaagttcacgaacaagcctcctttcattgctgacttcattttaagtgatggttgccggattggcaaacgaacaagaatcttgggggagtaaatgctataattggcaaagtgatatcaaaaagaagggatcttgcagatggaaaacttgataaccacctttccagaaattgaaattaaagaacacgagcccctggctcactacaccaacaccaaaaccggaggcccagcggactggctggcctttccggtcgacgtggcccaagttcagcaattagttgactactgccaccaaacggggttagcgctaacggtgattggtaatgcctctaacttaatcgtccgagacggcgggattgaggggttagtgatgatcctgacccggatgcaaacggttaaggttgaaggcacgatggtaacggcggccgccggggcttcttacatcgaagtaaccaagatcgctagggatcattccctgaccggtttagaatttgcggccgggatcccggggtcgattggtggggccattttcatgaacgccggggcctacggtggggaaactaagaccgttgtcgatcacgttaccgttatggaacgcgacggccaaatccaccagctatcaaacgaagaaatggactttggctaccgccactccgccgttcaagcaagcggggcgatcgttttagacgccacctttgcccttaagttgggggaccaaaatgccattacggcccaaatggaggatttaaacgcccgccgtgcggctaagcagccgcttgagctcccttcctgcggttccgtgtttaagcggccaacgggctactttgccggcaagctaattcacgatgcgggcctgcagggttacacgtctggtggggcgcaagtgtccaccaagcacgccggttttatcgtcaacgttaaccacggcacggccactgactacttaaacgttattcaccacgttcaggaaactgtgcaagaaaagtttggggtccaactggagactgaggtgcgcattatcggtcggcaaagctaacgggggtggttatgatgacctatttggcggcactcttaacgtggcgcaacttcattaatttaatcgacatcctggtaatttggtttttaatttacgagttgatggttctggttcgggggacccgagccgtccagctatttaagggaatcatcattatcattgtggtaaagctgatctcttggtacattgggctgaccactgtgtcgtgggtgatggaccagatcatcaactggggggttatcgccatggtggtgatcttccaaccagaaatcaggcgcggcttggaacacctcgggcgggggaccatgtttacccgtaccaaaaccgaaaacgaggaagaagaagccctgattacccaactcgatcaggcaattcaatacatgtccaagcgccggatcggggctttaattgccatcgaaatggataccgggctagaggaatacattgaaaccgggattccactggatgcggaagtgaccggggcccttttaatcaataccttcatccccaacaccccgcttcacgacggggcggtgatcatcaagggcggccggattgccgtggccgccgcttacctaccgctgtcggattccaagttaatcccaaaggaactggggacccgccaccgggccgccgtgggtatttcggaggtgacagacgccctgacgattgtaatttctgaagagactgggggcgtttcgatcactaaggataacgaattgatccgggacatgacccaagaaaattacctcaaattcttgcgggcccacctttataaaaaggagagcaccgatcagaataagcttttggaccggctggtaaacccgttccggaagggaggacgtcatgaaaaataacgataatagcttcttcagtcgtccgtgggtgatgcgcgggacgtcactcgtcttggccctgttcatgttcttttacgtcaacggctcctttttgcgtcaaaccactcgccagggtaatcaatcggccctgatgtcagacaagtcccaaaccattaaggtccccttgcaggtctccattgatagcaagcgctacgtggtaactggctacccgcagtacgtcaagattaagctgaccgggccatccgctttggtaaccaccaccgtcaacacccaaaactttaaggtttacgctgacctcagtgacctggggaccggtcagcaccgggttaagttgaaggtgtcgggattaaattccgagctgacttccagcatcgatccggaaacgatcacggtcaacatccaatcgaaaaagacgatcacggtaccggtcagcgttcaattgagtagcaagaccgttgccgatggctacgaggttgggacggccaagtcttcaatggccaacgtccaggtttccggggccaggagcgaggttgctaaggttgccaaggtggtagcctttgttaacgtgccccacacggcgacggccaccttcacgcggcaggtaaccttacaggccgtggataagaacggccaaaccttaaacgtggtcgtgacgccggataccctatccgtaacggtaccgatcacaagcactaaatcgtcatcgtcaagtgatagtggctcaacgtctggctcctcaagcagcagttcgggttcgtcagacaccgaaaccagttcagccacgtcgagtcgtcaatcatcggcgagctcccaaacggagacaaggagctccagtattcaatcagctagcagttcagcgagcaactagtagtcaagaaattaagcagggaagaaacgaggaagaatcatgaagttaaagtattttggaactgacggtgtgcgtggcgttgccaaccgggatctgagtccggaactagcctttcgggttggccgggctgggggatatgtgttaacccgtcactcccaacgtaagcgcccacaagtgctggtttcacgcgatacgcgaatttctggggaaatgctggaaaacgccctggtggccgggctcttgtccgtcggaattgaggtatttcgcttaggggtggtgaccacgccgggagtggcttacctggtacgggcccaagaagcggacgctggggtgatgatcacggccagtcacaacccgattcagtacaacgggattaagtactttggtggtgacggatttaaactctccgacgagctggagtacgaaattgaacagctcttggacgccgaagaagacaccctcccacggccgagtgacgatggcttggggacggtggaagactaccgcgagggggcgttgaagtacacttcctttttggagcagaccatttcaaccgatctggacggcttaaaggtggttatcgacggggccaacggggcaacgtcatcgtttatcgccaacctttttgccgacgttaacgccgatttcattccgctgcacgtgtcaccaaatggcttgaacaccaaccttaattgtggttccacccacccagcggacctccaaaaggccgtggtggaaaaccaggccgacctggggattgcctttgacggtgatggggaccgttgtatcgccgttgacaacgaggggaacctggtcgacggtgataagattatgtacatctgtggtaagagcatggaagctaacgggcgtttgaaaaaagacaccgtggtgacaaccgtcatgtctaacttaggaatgtacaaggccttagaaagtcacggtatgaagagcgttaagactaaggttggggaccgttacgtggtcgaagaaatgttaaagaacggctataacctcgggggggaacagtccggtcacatcatcttcttggatcacaacacgaccggggacggcatgctaactgctttacaattgttgcaggtggttaagaccagtggtaagagcctcaaggagttggccgcagacgtcgtgacctacccacaggagttagtaaacatcacggttgaagataaagaagcggccctaaacaaccaagaattgaagaacgccattgccaaagtggaagaaaagatggccggcgacggtcgaatcttggtacggccgagcgggacggaaccgctgctacggatcatggccgaagccccgactaaggaactcgttcacgcttacgtcagtcaaattgccgacgtggctcggcaagtcttgccaggggcgaagtaaaatttgtaaaaggactgagaggctgggaaagttattcccactctcagtctttttagttggggtgcaaaaaagtcaaccgcttgatagaccaattcgggtactcttggttgacattgttcgccattattattatgatacgtattgttaagaaattatcttttagcgagaatttatctataccaattttaaagattaaaggatggaattgctaatatgtgtggaatcgttggaattaccggtagcgaccggtctgttgaaatcttattaaacgggctcaagagcctggaataccggggttacgactctgcgggaatttacgttaatgatcaggcgggacacgactacctcgttaagcgtccggggcggatcagtaacttagaaagcgccttaacgccggatgttcacggtttggctgggatcgggcacactcgctgggctacccacggggaaccaaacgaagcaaacgcccacccacagtactccacggatgaacgcttctacttagttcacaacggggtgatcgaaaactacaagcaacttaaggaagaatacctgtcagacgttgacttcaagagccaaaccgacaccgaagtcatcgttcaactggtggataagttcgtggttgaatacgaaatggacactaaggcagcccttgtaaaggtgttacggttgatttctgatgactcagcctacgcctttgtcttgattgacaagcaagaaccggacacccttttcgtggctaagaacaagagcccacttctggtagggctggccgatggttataacatggttggttccgatgccttttcaatgatcaaggaaactaaccagttcatggaaatcgacgaccacgagttggtgatcgttaagcctgacaacgtagcgatccaagacttcgacggtaatgaaaagaaccgcaagccgtttacggttgatatggacgccaatgccgctgataagggcgcttacccgttctacatgttaaaagaaattgacgaacaaccggccgtgatgcggcggttagtttccgaatacctagacgccgacggtcaaccaatggtggaagaacaaatgctggctgacattgctgatgctgaccacatttacatcattggggccgggacgtcttaccacgccggcttagtcggggcacgtatgtttgaaaagttcgccaagacgccaacgacggtgcacgtttcctctgagtttgcttacgaacaaccactactgtccgccaagccgttcttcatcttcttatcccagagtggggaaacggccgacagccgggaagtgttggttaacgtcaataagaaccactggccgagcctgacgatcactaacgtcgacaagtcgaccttgtcacgggaagccacctatacgatgctcttgtttgctggccctgaaattgccgtggcttctactaaggcttacaccgcccaaatcgccgttgaagcagtattggctaaggccctgggtgaatacctgaagagcgaagacgctaaggacttcgatttaaagcacgaattggccaccgtcgctaacgggatgcaagcaatcaccgatagcaaggacaagctcgaagaaatcgtcagccactacctttccaagccgcgtaatgccttttacattggacggggagtcgactgggcagtttctttggaagcggccttgaagctcaaggaaatctcttacgtccaagcggaaggtttcgcctccggggaacttaagcacgggacgattgccctgattgaaaagggaacgccggtaatcgggatcattacccaggaccggacggccgggttgacccggagtaacttagaagaaacccaggcccgcggtgcaagcatcctaacgatcgtttcccgccacctggccaaggaagacgatacggtgatcttaccggacgtgaacccgtacctgacgccgttactgtccgtggtaccagcgcaactgttggcctactacaccagtttggggaagggcttagacgtcgataagccgcgaaacctagcgaagtctgtaaccgttcaataattaaattgatttagacacttctcaggaccagaagtgtctttttctttctgagaattagattaaaatcagcgtaatgacttcttttttgccaggaaaccttgacagcgcttacaagattgcctattatagtgacataaggtattaagtatttaccttctaatcaattctctttctctcttatgccgatcactgccttcccgggcagtgattttcttttttcaccgcttttttactgtgaacagcgtaaaataggaggagataagaaaaaaggagggatttgatggcacaacgtccaggaacgctggatctgattgaacagattacccggcttgacgggactaagtactttgaaattggtaacatggtccacaacggtcgcgccgaactggcggctgagcggggctacattaaggaagtccggattttgaagttaaacattccgcactcccaaaccgtaattaagtacgaaaactacgtcaacgaacacttttattcacaagaagaaacgatggatcactgggaggaatgggaaaagaccccagccgaagaggagctggtggcaaccattctgcgcgaaaatcacgtcggataggaggtcgacatgcaaaagatcaggccggaaaggaccgaccaggggagtcgctacgttacgggagtggacgggatgcggacgctcgcggtggtgggggttattatttaccacctcttcatcgcgcagttaccagggggctttttgggggtgcccctcttcctgttgatttcgggttactttgtcactgaccagctgcaaaatgagtgggaccaacatcaaacgatcgacctcattagtttttaccggcggcgtttccgacgcttgtatccgcccctggtggggatgttgttggtgacggtagtttacattaccctgtttagccaccagctcctttaccaactccgccaggtggtggtgaccaacctgctgtgggtgtataactggtgggaaattggccacggccagtcctacttcgatcgcttcagtggcgagtccccctttacccacctctggaccctcggggtggaggctcagttttatttaatttggcccgccctgttgtttatcgtgttagttggtttgggcaagcggcgccggttaattaagtggttgaccctgaccctggccgtgttatcggcggttttgatggcggtcctgtataacccggccaatttaaaccgggtctattacgggaccgacacccgtgctttttccctgttactgggggcgtggttagcgatggtttggccacgaaaacacctccggggcaatttggcccccaccgggaagacgatcctaaacgggggtggggtcattagcctcctaataattctaattggcttttgtagcttggatgggcaggccaagtttacctactttggcgggatgttcttgtacagcctcgccgggatggttttattggcgacaattgtccacccgggggcgtcgatgaatcgttggctaaccaacccggtcttttcttggatcggacgtcggtcgtatggaatctacatttatcaattcccgatcatgatcttttacgaggccaaggttcaagtcggggcgcaccccttcatcaatggcttcattgaggtggccatgattttggtggcggcggaactttcctaccgcctagtggaaatgccggccaaaaacctccagcttaaggaactggtggggaaactcaaaacgcggccagcgggcctcaaacggtgggttcggctgggagccactagtctcttggtttgcgtagcgctagtcggattagcgctgccggaaaaggcgccggctaagaccgccttacaaaaccacttaactaaagcgaacgaagctacggccgctcgcaacaagttaatttcggcggggaaggcccccaaggtaaatgttaacgctaagtctttgaagacgaagtaccaactgagcacgaaacaaattaaggccttggggaagctaaagataaccgtgattggggattcggtaatggccgacgccgctcaaaacatccaagaactggtgcccgacgcatacgtagacgcacaggtggggcgccaggggagtgcggggccggccatcattaaggaactcaaaaagaacggccgcctcgccaagatcgtggtcttaaacctgggtactaacggtccaatgaccacccaaacggtcaacgaaatcctagctgcggttgggaaggggcgccagatttactggattaacgcccacttaccaaccaagagctgggagaagacggtcaacagtcagttaaaaaagactgccaaggagcattcaaacgtccacttagttgattggaatgcccaatccaaggggcacgccagttggtttgccaaggaccgggttcacatgggaccggaagggaatgtccagtttacccggttgctactgaccacgattcttaaaaatgaataattatataggaagaaagaagaattgaaaccgatgaaaaagatgattgcactcgacttggacaacaccctgttaaataaccaaaaggaaattagtccggctaacacgaaaatcttacgccgccttcacgagcaagggataaaggtggttttatgtacgggacgaccgattaacgccatttggcacttgattgagcaactggacctgacccggccagatgactttacgattacctttaacgggggcctcgtgatcaacaatcaatcccgtgaggctctctaccaaaacgggctgagtaaggaggatctggtcccagttcacgactttatggccgcgcgccggttaccgatggacgtgttggactttgaacagatctatgaaattgatcccgaccaccgctccttgtaccggcaaacggttaaaaacatccgctttgaagacaccacctttgagcagttagcggcagaagaccacgtttacgccaagaatgtgatggcgattccggctgaggaaatgccagccgttaagagtgaagtgttggcaactgaccggatcaccaaacgggtacaagtggttcagtcccaaccctatattttagaatttctaccccagggtagtgacaaggcggtgggcataaagcacctcttaaaccactttgggttggattttgcggacctgatggcctttggcgacgccgataacgatgccgggatgctcaaggcggccggtgatggggtggtaatggccaacgggctccccgccgtcaaggcaattgccgaccacgaaacggcttctaacgaggaagacggggtggcacgttacctaaccaagacgtttgcaacaattttgtaatattcagctaaatttgaaggcaaatcgcttcgaaactaaggttctatgatcttttttcgaaagatttgcctttttttaggcttaatttggccaaccttcaaataaagttaggcaaacttaaaaaccccggccggttagcaattgatatctagtccgttttttcacgaacggcactttgttacaaaagattacaaaatcggcggttgttcgccgccatccgcaactcgcctgaaatcttttagtaacattctccttgtatcattaggaacgtaaatttgagagcacacgtaaacgaaaataaaaggatggttaaatactctatgttaaagaagaacttactgaagatttctgcaacccttggtgcggccgcattaggggtagccgctaccgctagcgttgcgaacgccgacacggtgtacactgttcagtcaggtgacaccctgtccggcatctcccaaaagttcgccaacaacaacagcttggttgattccttagccaagaacaacaacatccaaaacatcaacttgatctacgttggtcaacaattactgatcaaggacaacggtgaaatcacccaagctacgcaagcacaagcacaaaccttgccgtctgctaacacgactagcaccgcaagttcccaagcaagcacgaacacgcaagcacaagctaccacgccggcaacgtctagctccgatgacgctgcaaaggcttggatcgccgctcgcgaatctggtggttcctacaccgctcaaaatggtaactactacggtaagtaccaactttcccgtgcttacttaggtggggattactccgctgctaaccaagaacgggttgctaaccaatacgttgcttcccgttacggttcttggagtgccgctaagtccttctggcttgctaacggttggtactaatattaaaataatcataggttaggttatcactacgatgaaccccccggtggaattttccagcgaggggttcatttttttgtttaaccgagcggcgccctgaccttggttgttcgacgctagtttagaccggtggacgcccacggctagagacggtgctaataagccggctaaggccgcctgggcgtgagtaggagcggtgaagaaaatgaacgtggtcactggtaacagaacgggagggggctttttgaggcccaagaagggtgggctagtaattgtggtgcgccgctaaatcctgtcactggactaccatgatggtaattcagtgacagggttttgcaggtacaaaaaaggggctacgacattgtcgtagccccgaaggtgaaacacatgagctgttttagaaaagcagtttgctcattaggataacgaaggtcaacaggattaccgagctaatcgtggaggcaatcagggcgttacgtccccgggtcaagaggacccggaagttaacgctcatccccagggcggccatcgccatccctaagactaggtaggcgagcttaaccagcatggccaagaccggtgcgccaaggggaacaaaggtcccgatcacggaggctaagataaagccgagcatgaaccacggaattggtaaggagcccttctcgccgttggtggagccggccgccttagcctgcttgcgttggtaccaaagcccaatgatgatcgctgcgggggcgagcaagaggacccgggacaacttggtgataatggcggtgtctaagctgaccggcccaccggcggaaccggcggcaacggcgtgggcgatttcgtggaggctacccccagtcatgaccccgaactgaacggcggtcatgtgtagaaggggcttgaggccaatttcgatcagggtgaagagggtgcctaagatggcgacgatggcgacggcgacaacttcgtcttcacggtcgcgctcttcttggccttccttgctggtgaactgtgatgagatccccattacggcggcggccccacagatcccggtccccgaagcggtcaggatcgctaagtggtcttccaccccaaagcggcgggcgatgttgtaggtgaccaggatggtgcccgtgacgatgaagaccgccagggtgatcgttttaaccccggcctgggctaacgagatcaggttaagcttgaaacccaacaggatgatcccgagccgtaggaacttgttggaaatgaggccgatcccggcttgcgagtagctgattgccggttcgtaagtttgggcgagcatcccgaggatgagcgaaatcaccagggccccaatcacctcgaggtagggaaaaccagcgaggtaagaacccagcagggagcaaataagggtcagcccgaaggcagacgcaaagttacgtgataaaacaacgttcatgtgacgattgatctcctctctcttattacttttttaactttagcatggtatagttataattaaaaatactgaaaagttgtaagttagtaagctttatttataagaaaggagggcgccccgatgaatccgctttacaatcaccggcttttgaccctagtaacactggttgaaactggttctttcacggcgacggccgagcggctcttcattagccaaccggccgtttcccagcagatcaccgccttagaaaacgaattaaacctggagttggtgcaccggcgcggcaagcgaatccaggtcaccaaggcggctgagcacttaaccaactacctgcaccgcgaaagtctaaacgccgaccagctgttggaacagttgcgtggtgcagaaccggtcccgttgaggttgggggcgaccctttccctagcggagttcatgcttcccgagttactaggcgaattggtcgatgccggccaccaggttaagatccacaccgccaacaccgatcaactcctccaggcaattgacgatgggaccatcgacctggccttggtggagggaaacttccataaagaggcgtacggggtactccccctggggacggcggcgtttggcccggttatggcccaaccgcacggcccgcgcgattgggaagcggcctttaacacccccctttacttacgggaagcgggatccgggacccggatgattttggaagggtggctagcgacccacaattattcggttaatgatttttctcgggtcatcgaagtcgataacccgaccacgatcatcaagctgctcttgcagggacgggggatctcgtttatgtacctccccctagtggaagggctgcttcgggatggtaagttgtaccggttggacctacctgactttgtggtgaaccacccgttgacgatggtgtaccgcaagaacagcgttgccgagtcccaataccagcaggtggccagattcttaactagccaccacgaggggagtaagaagaaacatttgggtagggaaagctgagctcttggatgaatggattgatacaaccaaataaaaagctggagcgaccgttgcttaaaacggtcgtctccagcttttttaataagggtgatgtaattaaacggtgctggtggaagcgatcatagttaattccccggtcagggtccacgccgtcacgtcggccggcaagaggaagtggtcgcccttttggagggggtaagcgtccccgtcgacggtgagctgtccctgccccttgatgacggaaaccaaggtgtaggggcgttgggcggttaacgaaagctcaccgctgacttcccacttgtagacggtgaagtaaggcgaaagtggcggggccactagggtggtgatcgttgaggagccgcggtgctcaacgactggtgtcaggtgtggttcttcgaagggaaccgtggtcacgtccgtggcttgttgaagatggagcgcccgtttttgaccagtggtggcgtcaacacgatcgtagtcgtagaggcggtaagtggtgtcggagctctgttgggtttctaggaccacgatccccttgtttaaagcgtggatggtgccacttggaacgtaaacaaaatcgccggctttaacgggccgttttaagaagagttgtccccattcttggtggtcaattaggtcctttaactgtgcccgtgtcttggcggagtggccgtaggtgaggtaggaaccgggttcagcactgatgacgtaccaacactcggtttttcccagctcgtgctcgtgttcggcggcgtattcgtcatcggggtggacttgaaccgacaggctggcttcggcgtctaaaatcttcgttaataaaggaaagacgggggagtggctgttaccgaagagttccgggtggtcacggtaaatatcggggagcagttggccttggtagcggccgttggcaatctggcttggcccgtgggggtgcccagaaatggcccaacactcgccgatcttcccgtccggaagctggtagtcaaaatcggttgcgagccggcgtccgccccagatcttttcgtggaaaacgggaattaagaaaaatggttctgccattggatcacctcattaaagttagaaaacggtatcatacgtcctccagaataagaggtctgcaccaatctgtcaaccaccgggcccagttagccagcggcaaagccgatcattaagcccccctcctcggcgtatagggaacagagcccccggcattggttgatcgtgatctgtgccgttggggaggtggccgtgatcagggtggctagttgatttgcgccggcgaggttggcaacgtggtcgataattacccggccgccccgaaagccccggtcggttagttggtcgactagtttatttaagacccgcttgcccttgcgcgttttggcgactagttcaaagttaccttcggcgctggtcgagccaattacgttgatcccgagggcttgggccaatttagccagggcggggttaacccggccgttgttggccaaattgtttaaggactggagcatgaagagtagcttggtgttagcaagagtagcttccgtttgggtaaccacctcttcaaaggtgcgtccctggttgacgagctgggcaatttgttcggccagcagggccattgccggcccggccaccttagaattaaagacgtggatcttcacttcggggtgctcctcttgatagagctcggcggcgtggcgggcggcgttaaaggaaccggacagggctgcggtaatggtaatgacgtatatttcgtcggcgccaacgaaggcttgggtccatgccccggtgctggggcaggccgacccggtcttttctttggaggaaaagagggcggcttgaaaggagggcaagtcaaggtttgtatcgtcaacgtagtggttaccactaacggtgagggtgagggggacggtgacgtggtcaattccgttaatggttggcgtggtcagattggcgccggaatcagtgatgattttaatagtcatttttatacctcgattatctaagcggtttttgaaaaaccttattgacgctattctattatcattcactgatcaatgtcaacggttattcaaaaacttgatttcgggtgtggttgacgaataagtggcgcccttcttataatggtgggagaataaggaggagtaatgatgcgtgatttagagacccagatggccgagtcaattcaaggctttcatttacctcgctacggggagttgccggcggtggggttgtacttagaacaagtaactagcctgatcaatcaactactggcgcccttagaagacgtcaccctaaccagctcaatgatttccaattacgttaagtaccggatgattggccgacccactaaacgcctctaccagcgcgaacaggtggcggaattgatttttatcgccgtggctaagaacgtcttatccttagataacttaaagcgggcgctacgaatccaacgcgataattacgaggtggcggtggcctacgactacttttgcgaggaactagagaacctcctggccgttatctttggctttaaagaccagcccgacccggttggtaaggaaaacaccgagcaaaaacggatgctagaaaatttgatcaccgccgttagtcaccaggtgtacttggataaatactttgccgccctggaaaatgaggactaaagaagggggcgggaagtgacctcggagacaggtcgtttgtaaggttgggtgacggttggcgcactacgcaccatctttcggtttgcttggacaactgatttgcggtcagttaccacgcttgctgtttaacattcggaaagacaatcagagcccaggagaaaacacgtttttctcctgggctctgattgtgtatctgatctgacctggtaagttagttaatgactacttagactactaatattcgtcgtcggcgatcttatccaaggtgtcaattgacgggatgaagaagacctgaccgttgaccggggttgaatagtccaagaggaggtcgtttttggtgaacatgttagttaacatcgtcttggtaacgtcccagtagcgaccgtagccaatgaagtaagtacccgttacgttttcaccagggtcggagaaggggacgttcatccggataatcttgtgttcgacatcgttgcggttgtcttgggaaacaacgttatgagcgcgctggtttttgtcctcgtcgccctgttctaaatcggtgaacttccgccgcccgatgacttgctcctgctgctcagtcgagaggctcttccaggcgtccatttggtggaggtacttctgggcaaaggcgtaagagccgttttcaaattcggggtcttcttcgtgaatgatcccccattcgacggcatcagcgtcgaccgggttttccgttccgtcgacaaacccgatgatcgcccgcccttcaaagtagcggaagccatgggtctcatcaactaccttggtgactggccgcaagaaggtcattatctcatcaattacttcgtaggtgagcgactggtcatcggcccggacgtgaaagaagaggtcggccggagttcccggggcgtcgtatttgtcgcccttaatcccggtgaagtcttctaattcctttggcttcggggcctgcgggaagaggtaatcccaggccttgctagaaatcccgcaggcaatccgcaggtgactatcggggtagcgaacgtttaaggagcgtttgatcgcttgcaagcggtctgccgtctcctcaacggcggccttttcattggtttggtcttggcggttcagggaaagcatcaaaaagaggacgttttttccggcgtcacggtatacatcttgggaacgttgtgggttgactgacataagaacccctccttataaatagataaacagtttccacccttagtttagcaccattccagagaaagggttagcgaggggcgataattttggagaaggggtttaaactgtcctcgatcgttaccaaaaaccgctatttttttaaaaaatttaaaggctgattggggcaggagtctagatggtcaaggttgattgaaccggtttacagaacggagtttcggtcacgaatcccttaattggacaagattggtttaggttaatttgacccctttgatggttaaatctcccccccgaaagcaacacaagtcctgtaaaatatgttaagatatagtgcacttagtaagcgtttacagaaattatagggctttaaaccggaaacgagcgcatacttgctaggtcaaattataaatctgtaaggagagaatgccggccccataatttataccatccggtttataaggcattaggtggcagtagatgtttagtattatcttgatcagccacggtcagatgtcccaggggatccttcactccagtgaaatgatcttcggtaagcaagaagacgttgtggcggtctcattgaatccagatgaggggccggatgacttccgcaagaagttagaagaagccatcgccagtctgggcaataccgaaaagatccttttcttggctgacctttggggcgggacgccatttaatcaggcaagcaacctgattaatgaaaaggaaaagggcggtgactggttaattaccgccggaatgaacctgccgatggtgattgaatcatactcggcacggtttagtggccaagatccaaaggacgtcattaagggcatcgttggtgaggctaagaagggggttaaggtcttcccagaagaattcaacccgcaagaagaaaaaccagccgctccggctaagaaggccggcagcgctaatttaccaactagcggccaaattcaatacgttttggcccggatcgacacccggcttttgcacggtcaggttgccactggttggacgaaggcggccaacccagaccggatcatcgttgtttccgataacgttgccaaagacaagttgcgtaagaacatgatcgcccaggctgcgccgtccggagtaccggccaacacggttccaattaagaagatggccgaagttgccaaggacgttcgttttggtaagaccaaggcaatgctcttgtttgaaacgccagaggacgctttaaaggcgatcgaaagtggggtcgacatcaaggaacttaacgttggttcgatggcctactccaatggtaaggtcaacgttaaccaagtgttagcgatggaccaagaagacgtcgacaccttaaagaaacttcgcgacatgggcgttaagttcgatgttcgtaaggtgccaaacagctccccagaaaacatggacgagttgttaaagaaggcgcagtcattgattgacggtaataaataggatttgaggagagagaaaaatgatctcagttatcttagttatcatcttcgcgttcttagcggggatggaaggggtcttggatgaattccaattccaccaaccactggttgcatgtaccctgatcggattagcgaccggtcacttagtaccatgtatcatgctcgggggatctttacaaatgatcgccttgggttgggccaacattggggccgccgtggcacctgacattgctttggcttccgttgcatctgccattatttttgttcaaggtgggggccaaagtaaggacgttgggactgccattgcgatcgccatcccgctggccgtggctggtttattcttgacgatggtggtacggacgatctccgtggctatctcccacatcatggaccgcgaagccgaaaaggggagcatccgtggggtgaacacttggcaattaatcgccctgtccttacaagggctccggattgcgattccggcgattgccttaatgtcaattccgtctagcattgttcgtgacttcctgaactccatgccagcatggctgaccgatgggatgaccatcggtggtgggatggtggtggccgttggttacgccatggttatcaacatgatcgccacccgcgaagtttggccattcttcatcattgggttcgtcctcgccgccgtttcccaactgaccctgattgccattggggccttagggctggccttaaccctactttacctacaattggaaagtaagggtggcggtaacggtggttccagcaacggtggtcaatctgccggtgacccgctgggcgacattttggatgattactaaaccgaaattaatcaagaggtattgaattatggctgaagaaaaaattaagttaagcaagcgtgaccgcttcgatgcctgcatgcggtcaaccttcttgcagggttcctggaactacgaacggatgcaaaacggtgggtatgcctacgcaatgtcacctgccatcaagaagttatacaagactaaagaagaccgggcggctgccttgaagcggcacttggaattctttaacacccacccgtacctggcctccccaattatcggggtgaccttggccctagaagaagaaaaggccaacggggttgaagttgacgaccaagccattaccggggtgaaggttgggatgatgggcccactcgccggggtgggggacccagtcttctggtttactgcgcggccaatcattgccgggttaggggcttccctggccatttccggtaacatcatgggcccaatcctcttcttcgtgatttggaacatcttgcggattgccttcatgtggtacacccaagaatacggctacaagttagggacgcggattactgacgatacttccggtggcctcttacaaaccgttacccgtggggcttccatgatggggatgttcatcctcgggacgctgatcgaacggtgggtttccatcaagttcacgccggtcgtttccaagacgccactgcaaaagggcgcctacattgaatgggataagttgccaaacaacatgcactcggtgcagaaggttctgcaacaatgggacatgggtaaaggcttatccttgacgagcacgaaggtgacgaccttacaaaacaacttggatcaattgattcctggtttagcagccctgttgctgaccatcttgtgcatgtggttgttgaagaagaacgtttcaccgatcgtgattatcttggggcttttcatcgtcgggatcctcggtcacgttgtggggcttttgtaattgattaacgaacagccccgcttggtgatgccagcgacttcgtttctgtaccaaaactcctacggtaacatcgtgatcggcgatggtggtttcgagtactttgataacaaggaccggcggaagttcattgaaattccgtggtcagaaattgactatgtaatggtgtcggtctttttcaaggggcactggatcccccggattcaagtggtgaccaagaaaaacggtggttacatctttgcggctaaggaacccaagaagctcctcaagttgatgcaagattacgtccccaaggaaaatttcgtcaaaccgcgaccgatgttcaaacgaattagtggctggtttaagcactagcaataagaaaaagtcccgccaagctgttgcttggcgggactttttgtttggtggaataaaaaaggggcgccctgcttttaagcaagacccactacaaagtggagatggcgggattcgaacccgcgtccgagcatatcgccgcttcaacctctacgttcatagatcaactacttaaacttcaccgcaccaaacgccgttaatcaaggctaccagggacggctagcttgcaaaactctttttaagacctcaagcggcaatctcaaacgtagtccactgtagataaaacccggtaccgcaccatggacgagcccggccggatttacgcgcgctacttgttaggcagcgtatgcgtaagattgtgaattattgtttgcagttataatttaaaactgagcgtttttacgaagacgcaaccttcgaaacgcagttggagctcgacctatacccgtcgaatccaaaaacatccccaaatggaataaaataattttaccaagaatcttcgctaaatgcacgtaatctatctttaatatgaataaaacaaacatcaatatgaataaaacaaacatcaccgccaatgtcgtctataataggtagcacagatatccgaatgaaaataaatgcgaaggacggaatgataatgaaaatcctgatgattgaagataaccgctcggtatgtgaaatgatgtcgatgttttttaaaaaggagaagtgggacgccacttttgcttacgatggtgaggaagccgtggaaaagtttgcggccgaagccgacgactgggaaatggtgctcctagatttaaacctcccgaaaaaagacgggatgcaagtggccgccgacattcgccggatttcgccgacggtaccgatcatcatcttgacggctcgggactcggaaagtgatcaagtgctggggctcgaaatgggggcggatgactacgtaaccaagccctttagcccgctgaccttaatcgcccggatcaaggccttgcgccggcgggtccaattgtcgggaatcgccaacaaagccgaacaagtgacctccgaattcgacattcaaactagccacttcaggctcaactccaagacccgcgaggcttatttaaacggtaacttaatttccaacttaaccccgaaggaatttgacctgttaaagaccctggcctctaagccaaagcaggtctttacccgggagcagctcttacagttggtttgggattacgaattttacggtgatgagcgaaccgtcgacgcccacattaaaaagctccgccaaaaaattgaaaaggtggggccaaaggtgattcaaaccgtttggggggtcggctacaaatttgacgacagcgaggcggatgataaataatgcggttaatgtaccggcagatgctcggctttgtggccgtcatcttgtcattaatggcgatcctcacggtgtcgtttatttcggtcacggaccaaaccatttaccaatcgacgtggcgacaactcactaagtattcggatagcttggtttgggattcgattcgctacaaccccaagactaacgactttgcgggctttgaaaactcggcactctctagcaacgcccgtcttttgtcgcgccaggatgtgcactttgccatctataacgcggccaaaaaggaactatatgctagcaatggctttacgccaaagttaaccgctagtgattggaaacacctcaaaaacggtgatatcgtcaagaaaaaggctgattacccggcctttcgtcgggttaacgtggagggcaaggagtcatataagacgtcctctgaaatgaccttaattattcacccctacttctacaagcaaaagctagtggcgatcgtgaccattgggacctttgtttccacgattcgccaaaacgttaagcaactgctgaagaactttgtcttcgcctttttgctggccttgctagtggccctagtgatttcttatatgatcgcccgctcgttaaccaagcgaattgataagctcaacaccgcgacccatttggtggcccagggtaattatcaggttcacttggataacaagaataaggatgaactggacgaactaagcgccaactttaaccagatggtcggctccctacgtgcgtcacgagaggaaatccgtcgccaagaagaacggcgtaagcagttcatggccgacgtagcccacgagatgcgcaccccgttgaccacgatcaatgggcttttggaggggctagcttacgatgcgatccctgaagaagataagatgcacagcattcagttgatgcaaaatgacaccaagcgcttgatccggctagtgaacgataacctaaattacgagaagatccggactaaccagatcagcatggaacgcaaggtctttgatgccgctgccgtgctggaaaatctaagggagcaactgcgcaagaaagcggctgccaacaaggatgagctaaagctagtagtgcccgatagcattccggtttatgccgattacgatcgctttgtccaaatcatgtttaacatcatccaaaacgcgattcagtttaccaccggcggccagattacaattagtgcccagcgggtggcccaagggaccgaggttaaggtggcagacaccgggattgggatgaccgaagagcaggtgcaaaacatttgggagcgtttctacaaggctgaccgctcacgaatgaactcccagtacggggagtctggcttggggatggcaatcgttcgccaattagtggaattgcacggtggcaaaattgacgttgattcgacttacgggcaggggacgacctttaccgtcttcttcccggatcgggagtacgccccccacaacgggagtaaacacgatcaccacgacgatgcataaaccagtttattagactaaatttactgaaaatggtaagtagaccaattttttttaaagcgctgtggttagcgtaaaaccatttacggactctcctagacctggaacttgtgtttttgaaaagattgtgaaaccggttactatgttatagaatatttaggttgagatttgagaattctagattgttaggagagagagaatagagatggaatacttaatcgcacttatccctgccctcgggtgggggttgatgccgctgattaccgggaaaatgggtggctccgaagccaaccaaattttcgggattggagccggagcttcaatcgtggggatcatcgcctttttgattacccaaccaaccgtatcggcgggcgcctttatcttttcgatggtctgtggggccctgtggtcaacggcccaaattggtcagttcgtgtcctttaagcggatgggggtttcctctacgattccgctgtcaaccgtgttccaactggtcggaaactccctgatcggggtgatgatctttggtgaatggaggggtgctaaggccctcctgatcggttttggggccctgttaatcgtgatcatcggggccttgatgacttcggtttctgataagaagggcgatagtaaggtaaccaccagcaacgtcatcttcttattagcaacgacgatcggttactggatttactcttccttcccgaaaattccatacttggctaaccaaagctcagaggggatcttcttaccggaagtgttggggatcttggtcggggcaatcctgtacgagctctttaccggtaacgccaaggcctttggacaaaaggagcaatacaccaatatcttaggtgggatctcttgggggatcgcggcctttgcctacatctttgccgcccggagtttaggggttaacgttgcctttattttcacgcagttgaacgtggtgattgcaacctttggtgggatcttagttcttcacgaacacaagtctagccacgaaatgaagttcaccctgctgggaatcttgctaattgtaatcggttctgttgctaccatttttgcttaatttgaaatcaccaaaagccaccggcgttccggtggctttttttagcggaccttgtataatgagattagtttaaattttagattaacctgggggcaagaagatgatagttgatagtcggagccgaatccgttttaagaatcgcgaattagttttacaacaattattcaatgccgaggtgacgtcgcgggtcgaaattgcgcgggccctccagttaaacaagtccaccgtttcttctatttacaatgagctcgatcaagaagggtttatcgaagaagcggggcggggggattcaaccagtagtggtggtcgtaagccggacctggtgaaactaaataagcgctatggctacgttgcctcctttgaaattgggactgcccatttgagaatgatgtttaattacttaaatggggagatcattagttatgagcaggtggagcaagaggaaagtgacctgctctccatcatgaaggtgattaaagagcggcttcggaaaatgacggacttcgataacactcaagaagggttactggcgattggttttgccatccatggggtagttaacgacggcaagattaccgactccccgtttatcgagaccgatgggttggaccttcaaaagtacttcgaagagaattttggtgtccccgttatcttggaaaatgaggctaatttagccgccgtttttgagcgtgattttggccaagaagatgaggataaagacattgtaacgattagcatccaccgtgggatcggtgccggagtgattgccaacggccgtttgtaccggggttaccgtgggatggctggtgaaatcggacggaacttgattgcggatactgaaggcaagttagtcaaggtggaaaatctatgttcggaagaatccttgctggcgttggcaaggcagaaaaccggtactaaatataagcgagccacgttcgcccaggcttaccgggaaggggttcccgaaatcgaatcgatcgtggatgaatcgatggatcaactaagcaaggttgcctacaacgcggccaataattacgggccccaaacgctctactttagctcgccactatttgatgaattacctgaactttaccaacaggttcgggactggttagttaagcggggacttaaaattaacatcaaaatgattgcgggctctgagatgtcttccttgttgggagcgggatcgttagcaattcggacggccctgggactacagaagtaccgtttggtgatgcagtggccaaagaaggttaccaacgttgactaagtaaataataaatgggcgtcaggtgttcaagatgaactgctgacgcccattttttaattgagttagaaaggagaatgtagttgttacttagtggcggtttttagagcttttccatctttggcggttgctttttcccgcaggctttcttcaatgtcttctaaggaacgcccacgggtttcgaaaaccatggtgtgaacaaaccagattccaaggaagcaaagtaccccataaccgatgaaaagactcccggttccaaagaaatccagtaaaaacgggaaggtgagggaaacgatcatgttggcaaaccagttgacaaaggagccaaatgagttaccgaggccacgaatgttgagcgggaagatttccccgagcatcacccacatcacgggtccccaggtagcagagaaaaaggcgatgtagatggtcatagcgaggacacaaatgatggcagccgttttggaaccaccggagaacttcattccaaggctcataacgaacagggagatccccatcccgagaccaccccagattaacatcttcttgcggtcgatcttatccattaaggacatggcaataatggtaacaatgacgttgaagattccaatccctaggtgagctaagagggcggcattaaccccgaaaccgacgtcagtaaagatggtcggtgcgtaatacagaacggtgttgcaccccattacctgttggaagatggttaaaccgatggcggcgatcaatgcaggacgaaccattggcccaaagagctctttaagtccttcgtttttcatattgacctgttcggtgatcttctctaagtcaacgttgaccgcttgttggtcacccttgttaatatttattaagactgctttggcctcgtctaatttgccgattttgacgaggtagcggggagattcggggagaaaaagcccccctaagaacatgatggtagccggcagggcagccaaccccagcatccaacgccaaccggtgtagaagccttgcaacccccagttaacaacgtatgctaggaagatcccggtcatcaccatcacttggaagagagaggaaacaaccccgcgtttaacggcgggagaaagttcggctaaataagtaggcaccattgaggaggcagcccccacggctaaaccaaggacgacccggaataaaattaagattaaggcgttagaagcgaacgcacagcctaaaccaccaataataaagataatagatgatagcaagagtaactttcgccggccatagcggtcagaacttggcccaatgaccagagacccgatcattgcgccgagcagcaccccggaaacaactattccttgcccccaggagccaaggtgcatttgcttttcgatgaagaggattgccccggagatgaccccagtatcgtaaccgaagaggagccccccaagcgcgccaaagaagtagatgaagttggtagaaacttttttcataacgatactccttgcagatttgagatcaataatgttgtgagagggtaagttaattgtttgttcgtttgttagttgctgataaaaactaacaccgaaattataaaccatttccgttgggttgggaagcggtttctaaggtgcgtccaaggatggttaatccatttacttcatttaatagcgccgttttataatgatgagattatttttataaagcgtaaaaaggcgttttttggtacggaagggtttacaaaaggtggtgacgggggtagtattctattcgtaagttagttgttttaaaaaaccaatctaagaacagtacttcaggaggctcgaaatatgagtgatttatggcaaggtatcgataagattagttacgttggtaataaaggtagtcttaagtctggtttaggtttccaatactacaacccggaagaagaaatcctgggtaagaagatgaaggattggctgcgcttctcagttgcctactggcacacctttgaccaacgcttggtcgacccgtttggtgatgggactgctacccgcccatacgacaagtacacggatccaatggataacgccttagcaaaggttgattacgcctttgaattttaccaaaagctcggcgttgattacctttgtttccacgaccgtgacttggcgccggagggtgacaccctgcgggaatccaacgccaacctagataaggtaattgacaagatcgtggaaaaccaaaaggcaaccgggatgaaggtgctgtggaacacttccaacctctttaccaacccacgtttcttatccggggctgggacggcgccatcgtcaaagatttatgcctacgcttgtgcccagttgaagcacagtctggaagttgggaagcgggttggcgctgagaactacgtcttctggggtggtcgtgaaggttacgaatccctttggaacaccgaaatgaagcgtgagcaagcccacattgctaagatgttccacctggccaaggattacgctgatgaaattggttttgatgctcagatgcttctggaaccaaagccaaaggaaccaacgacgcaccaatacgacttcgatgccgccacgacgattgccttcatgaaggaatatggcttagacaaggacttcaagctaaacttggaaggcaaccacgcaaacttagccggtcacacttaccagcatgaaatccgcgttgctagagaagccgggatgctgggctccctggatgctaaccaaggtgataagctaattggttgggacattgatgagttcccgtccaacctttacgaaacgacggccgcaatgtgggaagtcgttgaaaacggtcaaattgggccacgcggtggtttgaactttgacgccaagccacgccggacctcttggcaagcagaagacctcttctacagccacattgtcgggatggattcctttgcagccggtctgcgagtggcggcagctatgaaggaagacggcttcttggatgacgttttgaagacccgttatgcttcatgggacgaaggtctgggcaaggacatcgaagacggcaaggaagacttcaagagcctagaagaaaagcttttggacaccccacaagctgaattgcgggcggcaactcaatctgaccaccttgaacagatcaaggacacgattaaccactacatcatccaaaccttagcaaagtaacatccatttacccttacagataaaatataattaagggaaccgcaacgacgcatctcggtgcggttcccttttttggaggaaagaaaatgaacgaatacgttattggggttgacctggggacgagtgccgtcaaggtatcggcgatgaataaggccggggaaatcgtggcccagcaaagctatgactacccgttgagccaaccacgaccaggctatagcgagcaagccccccaggattggctatacgcaacgacgattgccattgaccggctaattttacgggacggaattgccaaagaggagattcaagggatttcgttttctgggcaaatgcatgggttagtgctattagacgaaaataatcaggttttacgcccggcaattttgtggaatgacacgcggacaaccaagcagtgccaagaaattatggataaagtgggggaggaatttattgagattaccggtaaccgccccttagaaggctttactctacctaagctcctgtgggtgaaggaaaatgaaccagaaatttgggcaaaggcgaaaaccttcttgttgccgaaggactacgtacgctattgtatgacgggaaagctaggcatggattattccgatgccacggggaccgttttgctagacattcaccaggggacctggagcaaagcgctttgtgaggccctagatgttccactttctatctgtccgccgctggtgaaatcagttgacttgacgggaaatgtctcggctggctacgccatgttctcgggacttgccaccacgaccaaggtctttgctggtgggggcgataacgcctgtggagccgtgggggctgggattttacagccgaacatggtcatgtcttcgattgggacctctggggtggtcttaaaatacgaagaaaatgccaacgttaattaccacggtcaattacagttcgaatgccacgctattccagatagttactactcgatgggggtcacgttggcagctggtcactccctgaactggtttaagggaacctttgatagtgaagaagactttaaccagatggttgctaaggcttcagaacggccacttggggctaacggactgctgtttaccccttacgtggtcggtgaacgggcgccgtatgccgatgccgacatccgggggagcttcatcggcgttgacagcatgcaaaaccgctacgactttgtccgagccgtaatggaagggatcacctttagcttccgcgatattttaaacatctacgagcaaaatggtcgtgactttgataccgtggtagcgatcggcggtggggccaagagtgacttttggcttcaaatggaagctgatatctttaataaaaaggtcgtcgccctgactaacgaacagggaccaggccttggcgccgccatgattgcagcggtggggctgggttggtttgacaaccttcaagagtgcgccaaggaatttgtcgactttggcaaggaatatcagccagactcggctaacgttgctaagtatgatcaactatatggtttataccaccaggtatatgaccagactaaagaactcagccatagcttgttgaagttccggcgggaaaactaatttaatcacagtgaagatataaagaacctaccaatccgattacgtacaataccccttagggttgacactttaaataataaaagtgtcatctctagggggtgttttgaataggaacatattcaacgacagaaaaattaaggttactcagtaattaccaagattcagactactcactcggggtatacgcggattatcaccaggtgcggacctctagccttaacagatggattaaacaatttttaacggctggtttggctggattgattcgccctgaacacaatcacaggtacacacttcaaaccaagcgaccagccgttaaagcttacctttcaggtaccctgtcaggccaagcaattctcaatagatatcaaattcgtagtctttcccaactacatcaatggattgtccggtacaatagtggacaattaagtgttgcttacgcaacaagaaagcgagctaggaaagtgggccgaaaagttacttttgaggagaaacggcaaattacttaatggacaattgatcacgagtataactatcaagccgcggcagaaaaatttaatgtcagctatcaacgggtctattcatgggtacgaaagtaccaaagaactcacgattgggaatcccttcaggataaccggggtcgccataaaggcaaaacaccaaccaatgaagtggaaagattacgacaagaagtaaggcagctgaaagctaaagcgaaggaacgggaggtacagattgccttcgcaaaaaaattggtcgaaatacacaatcgggaggtggaacggccggacgatatcaagcgattcaggaaatgagccaaagtgggtataaggtgtctgatctagttaaagcagccggggtaagtcggcaggcttactacaagtggcttacccatgaaccgacggttcatgatattcaagatcaagaaattctaaagctcgttaaacagttagaagcacaacataaacactgcgttggttatggcaagatgacccgtttgataaagcaggaaagattatcatacacagttaacaagaagcgcgtcatgcgcattatgaaggaacacagtattaaagcggactatcgtcagcctaagagaaaacgtgtgcaggagcaggaaacttatgaagcacagaataccctgaaccgccagtttgaacaagctgccgaaaatcaggtgtgggtgacggacacgacggaaattgcctacaacattcgtaagtacaaggtccgtctacacgttgtcctggatctatacggtcaatacccacttagctggattattacgcctacagaaacgagtactggggctattaaagcatttcaaatggccaagcagaaagccggaggtctggcaccgctaatccacactgatcgcggagcagcatatacttccaaagcattcaaccactacttggctagtaataacagccaacatagttactcagccccaggaacaccagctgataatgcggtgatggagcactggtgggctgattttaaatctatctggttagcacactcaccacaaccacaaacgtttgaagacttagaacagctggtgacagaaggtatcgattactttacgcattcctttatttcaggcaaaagaaatgaccttaccgcagcagaataccgcttcggcaaggccaactagtttttattatttaatgtgtcaacttgacagggtacagtaccgacaaaagaaaattatcaagatcaatagtgatgctagtcgattcatctataacgaaatggtcgctattaacaaggaactttggcggctaaaacaggttaaactcccgattgataccattcagaaccggattgagcaactggagcttcgccaaagcgctaaacaaatgtctaatcatttccagttcttagaagataaaaggattgatagcttgactaaagccaatgccattcaaaactaccataaagcttggaatgcttttcgcaaagttcaggtcaagtccaaaatgttggtgtaaattaaattccgcgaatttatcatttcacaagcttaagcataccggcttcttctgaattgtcatctttttcaatcccgtggtaaacggtcatgtttaagtaccgtggaccagcagcccaattttcattctgttcaatcagtagtgctcccattagtcgcaagacgcttagatcattcgggaatatccggattacacggtcacgacgacggatttcttgattaacccgctcaattgtattattcgtccggagacgcttccttagctcctctgggagctggtagatcaccattaattcgtcaaaactattttctaatttcttcaccaccttagggaactcggtctgccaatctttaaccaattggtcacgccgttcaaccgcttggtcgtacgttggagcattaaataaatctttgagtcggttagcaacttctttacgatccttgagtgccagaatacttgtacagtcattactaaaatgaaattgacatctctgccaaaggctaccctgaaattgcgtagtgattgcatcctttaagccacaatgagcgtctgaaacaaacatatcaacgttggtaagaccccgctgtttaagttcactaaagaagtccatccatgcagcttttgattcactatcaccgatatcaaaaccgagcacttctcgacgaccgctagggtcgattccaatcgcaacgagtaagctattacttgtcacaacgtgaccacggtgtaccttaaataaaattgcatcggcatacacaaaagcatacttttgcgtaaggggacgtcggttaaaatccagcacttggtcgtccaaattattgcataaagccgagaccgtacttttagaaaaggttgtcccacataacttcttagtaatctcagctactttacgtgttgaaacaccttggattaccatttccattaatgccaaatcaaaggcctgctcactacgctggtagcgtttgaacagctgtgttgaaaaattaccatgacggagtttaggaacgtgtagttctagagaccctacgcgggtggtaagctgacgaacccgataaccattccgtgaattggttcgctcatccgaacgttcataagacttagctttaatctgctcagtcgcttcggacttaagaatttcatcaaggatcttggccataattgattgcatggccttatctcgatcacctagtaatagctcctttaattcgtcatcctctaaatttaattcaacttttggcataatgaagttcctttcagatttcacaaagtcctatttagaatttacaccaattatacggacataaccaaagttcataccgcaggtgtgcctaagtttcaccggaaaagttacgtctggcgttatcaaactaactgccagtatttgaaacagaaggcagcatacttaactaacggaactgtacattttgaagatagtaagcatgttatagtgcctaaattaggttggctccgtgttaaaggttcccatcaacgagtcttagctcgcagtgctgaaacccgtattggaacggtaaccatcgtaaaggacgctagcggtcgtttctttctctcaatgcagttagcgtcggatactccctttgtcaattggccgcaaaatacaggcaagcagattgggattgatcttaatactgaaaacttcttaactactagtaatggcgatactgtggctaatccacgctattaccgcataattaagggtcgcttagccaaagcacagcgcatcttatcgcgacgggctcgtcgggccgaacaagaacatcgaccattacggactagtaagaactaccaaaagcaacgcttgttggtggctaaattacacgcccaagtctttgaacgtcgacgtgactttctccacaatgtctcgactacactaatcaagaaccacgatttcgtagccgcagaggaattgcggagtaaaaatatgctgaagaatcatgctttagcgatgagtattgcggacgtaggttggcggactttcttaggaatgttggcttataaagcagaactctaccatcgccaattccttacggtgaatcctaagaacactacgcaggcttgccatgaatgtggttttgtgatgggcacagcagggaccgaaaaactcacacttgcagaccgagaatggacatgcccaaagtgccatgctcaccacgttcgtgaccataacgctgcgcagaatattctaactaaaggaattattaaattagcctaatttggctcgtccctatggcaacctggggacgctaaaggcattggtaattgccgtgtaagacgaaacggttcgtagaaccgttcgcagtggtgtatctatgcaaattgtgattcaaacactcatcagaagggtgcttgctcacaagccactgactttagtcagtggtggttgacgttagttgttaactaattaaataaactggttgattgtttcagatttgaccccggtgattgtaagagaatatgggtagtaaagagggcattgtactggttaacccaacgctgtgggtaagtcagggaaaataggccgaaatttacaaacacttactgatattaaaattattttacccgctttcttgggtggtatacaataacagcaagtaagggtcgacccttgctcaactgttacgtaactttagggataattacccttggattttaaattaaggtttacactaagttagaatcgtgctaatctagtggttacagatgataatcgttctaaccaaggagggcattcagatgaactttttaaaccaagaaattgacgactttaaggtgcaagcataccaagatggtgacaccaaggaagttactaaggcggacgtcctgggtaagtggagtatcttcttcttctacccggccgacttctcctttgtttgtccaacggaactagaagcattacaagataagtacgaagaatttaagcaagcagacgccgaaatttactcggtttccgaggacacggaattcgttcacaaggcctgggcagaagcttccgaggaaatcggtaaggtaaagtacccaatgttggctgacccagccggtaagttagcacgcatgtttgatgtcttggacgaagaagcaggccaagcttaccggggtgtcttcatcgtggatcctgatgggaagatccaatcttacaccattaacaacatggggattggtcgttcggcagaggaaattttacggacgcttcaagcggcccaattcgttcgcgaacacggtgaccgcgtttgcccagctaactggaagccaggcgacgataccattaagccaagccttgacctagtcggcaaactgtaaagggcggtgatcccgatggaccaagagcacatttacgatttaattatcatcggcgccggaccggccgggctttccgccggaatttatgccggacgtgcaacgttagataccctaattttagaagcggacacggttggtggtcaggtcacgaccacgtcaattgtttataactacccagccgcgccggccattgatggcactaagttagccaaccagatgcaaaagcaagccgctgactttggcgtaaccattaaacgtgatggggtgcaggaggttcaactggatggcgagatcaaggtaatcaccaccaagagtgggcaccaataccaagcccgtagcgttgttgtcgccactggggctcacccacgcaaggttggctttaagggcgaagatgaatttcggggccgtggggtagcttactgctccacttgtgacggggagctcttctccggcctgcaggtcttcgttgttggtggtgggtatgccgctgccgaagaagccgactacctgacccgctacgctaagcacgtaacggttctcgtccgtggtgatcacttctcttgtccaccactaacggcttcacgggcactcgataacccgaaggtctccgttgagtataacaccgagatcaaagaggtttcaggagacacctacttaacggcgatgaccttggttaacaatcagactggccaagaacaaacctaccaagttgaagagggcgataagacctttggcgttttcgtctatgttggaacggaaccagaaacggacctctttaaggggcaactagacctcgacagccatggttacatcctggccgatgaacagtgcgccaccaacattgccggggtttacgccgcgggggatgttttggctaaggaattacgccagatcattacggcagcttccgatggtgcgttggcggctacgaacgcggaggcttacgtaacggcggaaaagaagcgcttgggcatccctgttcacgttaccccagctaagccagcggccaagaccgtgggccaaactagccaggtggcggaccagccagcgtcccaacacactggtgattggttcacccctgacctcgttgagcaactaaaggcaatctttgggcgcttaactaaggacgtgaccctccaggtgctgggggacgatagcccattaagccaggagttaacctcctttgttgatgagttagcgaagttggattcccacctccaagttgcaaccgcaccggttccggccgaccttgacttggcaccacagcttcgcttgcttgttgatggtctagacaccgggttacactttgctggggttccgaccggtcacgaaattaattccttgattttggggatttacaacgtggcggggccggggcaagagattgcgccagaattggtggaacggatcaaggccctgccggcaaccgaaattgagatcggggtttccttaacctgtcacttctgcccggacgtggtggccgcttgccagcggatggcctcgttaaacccacaagtaacggcaaccatgatcgacctgcaacacttcccgcagcttcgtgaggaacggcagatcatgtccgttcccgccacgatgattgatggtgggccggtgatcttcggtagccaaaccttggaagaattggtccaggcggctgaacaggcgacagttaaaagctaagaaaatcaaaaagtggattggtcttaaccaaaagaccggtccacttttttggtgccagagattgaaaacggctccacaaacggttattattcttattagtgaaaagtatgacaagtaagaaagaggtaattgaagacatggaaacgttatcgtttgattcaagtgcgttaaagaagtttgttcacccaaacgaactcggtgaaatgcaggcgatggtgaccgccgccgacagcgagttacgcaacggtactggggccggcgccgacttccgcgactggctgcacctgccaaccgactacgacaaggacgagttcgcccggatcaaggcggccgccaagaagatccaagccgattccgaggtcttagtcgtaatcgggatcgggggctcttatttgggcgcccggatggcggtggatttcttgcaccactccttttaccaggcccaaaccgcggcggaccgcaagcaaccgctggtcctctttgccggcaacagcctctcctcttcttacatcgccgatctgattgacgtgatcggcgaccgcgacttctcggtcaacgtgatctctaagtccgggacgacgaccgaaccgtcaattgccttccgggtcttccgccaactgctggaagacaagtacggggtcgacggggccaacgcccggatctacgccaccaccgaccgtcagcgcggcgccttaaagaccgaagccgacgccgagggttgggaaaccttcgtgattccggacggggtcggcggccggttctcagtcctgactgctgtggggctcttgccgattgccgtttccggcgccgacatcgaccaactaatggccggggccgccaaggccgaagccacctacttcaacccggatctgacccaaaatgaggcttaccagtacgccgcttaccgtaacattttgtaccgcaagggatacacgaccgaactgctggaaaactacgaaccaaacatgacgatgctggccgaatggtggaagcaactggccggtgaatccgaaggcaaggaccaaaaggggatttacccgtccagcgctaacttcaccaccgacctccactccctgggtcaatacatccaagagggacgccgtaacctgatggaaacggtcgtgaagctggccgaaccaaaccacaacgtcaaggtgccgagtgccaagagcgacctcgacggcctcaagtacctggaaggcaaggaaattgattgggtcaacacccaagcttaccgggccgtggtcgctgcccacaccaccgggggcgtgccggtgatgaccgtcaacattgccaaagaagacgagtttaccctcggttacctgatttacttctttgaagtggcgatcgcgatttccggttacctaaacgggatcaacccgttcaaccaaccaggggtcgaagcttacaagaccaacatgtttggcctgctgggcaagccgggctttgaagaaatcggtgaacaactcaagaaagaaattaacgactaattgacaatgaaggcccggttaaggaaactttaccgccagttgcagcaacaactagcggtgggaatggtgactacggtggtgctagcaattttaagcatcagcggctcgtggccctttgtcagttacatgaccctcgccgccctagtctactgcctggttattctaggcttgtggctatgggtggcaatcgagttacacaggtaagcgggtgaggtgacctcctggtaaacctaataactgagcgaggacggaggttgctacggactgcaatgagtcaagccccttaactaaatgaaagccggctaattcgcaatttggcgaattggccggcttttttcgattaagattacttactaacttggccttaaagcggcttaatcatgttgtaccaaacctcgttagcatgggtagaggttgccaccccgtggttttggtagccattacgctcgtaaaagggaatccggtcgaccagacaggttaacgtcaactggcgacatcccaggttggtggctaccttactaagggcggtcagtagctggctgccaatgccttggcttcggttggccggggcaacggctagcgatagcaccatcactgaggaggggtgggaagctgacttgacgccaggttcgtacatccagtcctcaatgacgtcgccaactagggccggtccacagataaaaccgaggaccgtgtccctcactttggcgaccaaaaaggtttcgggaaagtgattaatgcggtcaatgaaggcctggcgacttcccgcctctttgggggtaaagccggcccgttcaatggccacaatttgctcgagatcggttaagcttgcctgggtaatttgcatggggtcctccgagaaacttagttagtagagctggtggaacttgcactagcgctttggctgtacagcttttggacgttttggacgtcggctggctggatcgaatagttcgacccggctggttgcatgaccgagacctcgtcgctgtggtccaagccaattacgtgaccgagctcgtgttccgccgtgttgacgattcgctggtaggaatagccgtaggttggattaagtaagtaggcccggtttaggtaaagcttaccggagacaaagtagccggtggcttcgtcgaggctcatttgggttagccccgcggcttggttggagctattatccatcgtcgagacgatcacatcggcctttttcttatcggtggtgatgttaaaggtaaaagctccggtaccgttccactgactgacggcgtcttccatggcgctcttgagggtggggttttgaatggcgatgtacaaggtggcactggtcttgacccagcgcccgccgccgccctcgttaatggtgctcgtgtgactctggtgttccttttgggtggtggtcgacgttccttgacccgttagttcccggacgtagttctccagatttaagacaacggtgtcggtccgttcatgaaaggtagcgttgttttggtaggcccagatcccggccgcaaacagggcgaaatagaccaggggcgtgatcaaaaagcgaaggaaacgaatggcactcacctcccgatgggtaaaaaagcaacgccccgtcgttagtggggatactgttggttaaattcgtaaactagttcgggttcctgactgagccggtgatttttatccaggcttgcgatcagcgccatttcttcgtcggttaaggagaagtcataaatggcggcgttttggctaattcgggcttcgtgaaccgacttagggataaaggaaattccggattgcaggtgccaacgcaagattacttgggccacggagcggtcgtggtggtcggcaatttgcttaagaaccggttcctccattaattgcccccgacctagtggtgcccaggcctgggtaacgatttggtgttcctggttgtacttaatcatcggcgtttcttgtagccaggggtggcgttccagttggtcaacgacaggcatttcccgtgcctgggtggccaagtactggagatggatcatgctatagtttgacaccccaattgacttggtaagcccggcctttttcaggtcttcaaaggcccgccaagtggcaaagaagtgttcgttaaccggccagtgaaccagcaataagtcaacgtaatctaattgaaggcgggctaaggattccttgaccgaggcgattgcctgatcgtagccctggtttttctccgcgaccttagtggtgatgaagtagttgtcgcgtggttggttaagttccttgagggccttgcccaaagcggcttcgttttcatacatctgggcggtatcaaagagccggtaaccgacttggtaggcgtgggtaacggccttgatcagttcttgatcatcggtaattttgtataccccaaaaccgtgggcgggcatttggttaccatcggctaagggaattaagttggttgaaatgtccataaacggattcctcctcggtgatttcttccattataaccaaaaatggcgggaagggaattagttgtacttgccaccgctagtttaagacgagtaaaataatcaaagagtttccactagcaacgaaagcgagggattaaccatgcgcaaaccatttgtggtcgcgaattggaaaatgcacaagagcgttgatgaagcgttagactttatccggagcttgcaaggccggcttcccgatgccgacttagtcgaatgcggggtcgccgccaatttcttagccctgtacccaatgttacaagaggtcaagggccaaccgctggaaattatttcgcaaaacgcctatgccgaatacgagggggcctacaccggtgaggtaagtcctaaggccctggccgacgccggaattaattatgccttgttaggccacattgaacggcgcaagctttttaatgaaacggacgatttggttaaccgaaaggtaatcgccaccttgcaggccgggatgaccccgattatttgtaccgatgagacgatgattcaaaaagagtttagtggtagcgtccactacgtctttgaacagttaatcaacgtcttgcggggcgtttccttcgaccaggtaaaaaacattatcatttcttacgaaccgagctgggcggtcggggttggtcaacacgccaacccgaacctggccgaagaagggtgccgcctgattcggcaaacgatcgccgactcgtattcttacgaggtggccgataagatccgaatcctctacggtgggagcgttaatcccgaaaacattaagcaaatcatgaacaaaccggacattgatggggtcttaattggccgggcaagcctcgacaccgataacttcttgtcgatgatcaatacggtagtcgaactttataagggtgctaaataggacagtaggggcgtggttattggccacgttgcctgtctagcattattgaatacagtaaggggctaagagaaaactggtttttctcttagcccctctgttaattaaaactattcggccttttcaatcacgcttaggatgtcgtcttggctaaagtcgtggttcatgaaatcagcatcattcgtcggtaggtgcaggtccagtgaatcaaattgttggaaacctagggcacccgtgacacccccgacggcgagcacgtggccgccaaaggtgtggtcgtctgataagaagtgccaatggaatccacccacggccgctccggcgtacagggtcggcatgaagtagcctaacaaggtcccttcaatgatgtcagcttgaaagacccgttgatcatccgcagtttgggcgagggttttatacggcgggttagacttgatgaccgcccgggtggttacgtttttaaaggtccccttaacttcaacggagaaaaaggtgttggcgctgtggccctttaaaatgtgcttccctagttggtcgagttctaggtcggcaacgtttcccagtgactggtagtcggcccagtggatattaccaaacggaatcgtgtcttgctttggcatcacccggacctcaccgttgccgcggacctggtagaccacgccgtttaggatgattaactcaccatcgagtccctccccggtgccaataccggtatcaccgtgttccaatagcccaccgctagtgagggttccctttaaaagtccgggtaccattagggcgagggtaccgtgttggtataaaacgttggttttgaccatgattacttcctccgtagtgattcttgatgatctgaaaacaaaaataggatgaacgaccgtcgtaacggcgttcatcctattttgctttataagtcacccgcacggggatcgaacccgtaactccgccttgagagggcgacgtcttaaccgatttgaccagcgggcaatcaatgtttggggagttaattaacaagacccaagcattagtttacaagatttatggtcgtttgtaaaggggcatctttcccccgttactcataagatagttccagtaggtaggcccctcttttggggaggtgactggtggttacccagacgtcgtggtaaccaggtttaccctgagcggtcagttggtagtagtcatcaagtagggcgccgtttttagcgacaaagtcaggggaaagccggttgaccattaggtggccttccggaaagtagtaagcggcgtcggcaacggaaacggagtccttaaacaacaaggagaccgtattttggtactgagcagtagaagccatgaccagctccgggtggtgctggagcttggttaaaacgttgtaaagtgaatccgaattactagccatcaataatcctctctttctctgcagcttattgtaacccatttttaggggtggaaaacaatcattttgacgaaaaaccttgacgagacaacaaaatttgatatacttaataccgttgcttaaccaagcaaaacttttattgggcattcgccaagctggtaaggcactggactctgaatccacaatgcgctggttcgaacccagcatgcccaatctttacacgtcctgcgggacgtgtttttttatgccctgaaaacgggcgcccaccatcactttcgacaaataagtaacatttcttgcgattcagttacaaatttattgcaaaagtgttacaatgaatttgtaaacaaataggaaatttaataaaccgtgatggggggtaatgactatgatgattaagagcaaggttcttactagcacagtgatgttgatggctgttttaggattagcggggtgcgccaacgccaacacgagtgcgccctcatcatcaagttccaaggcatcgagtgccaaggtggttaaggatagtggaagcaagaagcccactagtgaaaaggcaagtatgtcgagtagtcaaaatagttcagcggttagccaagcaactagttccaaggtatcgagtaccgcaagtagcaccactaacgttagccaagcggctagcacctcaagcacaccggcttcttcaactagtcgtcaggtagctagtgcgacagccactaaacaggcaacgccaacgacaccggcagctgcaagcgttgcgtccgcttctagtagccaagctagttctagtagcgtggtaactagcccggcaacggacacgtcagttttacaaaggttcttcgccgctagcggggttagccaagcgaatggtgatagttacttagtaacccccaaggcggacggtagctatcaagttgagatccgtaacaacggtggtgacccgcaagttgccagcttggtagggatgtaccaatacaacccaaccactaaccaagtacaaaagatgaatatcgtaacggggcaatatgagtaattaagttagtttagtaacgcaagagacttggagaacgttggtgttctccaggtctttttttggggttaaattagttgacgcaagggagaatctgagtaaaactaacaatcattagaagtctaatgattataagtctaacgattttgaggagggggactagtggtaagtgatgaggagatctttcaaagctatcacgacttatttatgcaaattcgtgacgtggtgattaaacataagaaggcggcgggctttcatggggcggcacggatccttgagtcgcttaataaacaagcggacttgtcacaacgccaattagcggatgaagcaagcatcaaacccggttcgttaacggtagcaattgaaaaattggagcgccagggtttggtcaccagaaagcgtgatccccacgacaagcggattatccgggtggcgattacgcaagcggggcgagagcaatgggctaaggttcaggcggaccgggagcggtttggtcaacagttactaagtccgcttacgccatcggaacgtgaacaaacttatcaaattgcaatcaagcttcgccaagcattaattgaccactatggtgagaccaacgcacgaaaggagtttttcgatgattagaatcgcacggcgcaacctagagaaattgccggccctcttggcggtcatcttcttattggttcaggtggcggccgatctgtacctgccgaccatcacctcggacttaattgataagggggtgattaaccatgatatggcctacatttggcaacaaggtggcataatgctcttggtggccgccctcgggttgctagcctcggcttgtaacgtttacttcgcctccacccagggaatgaaggtggggcaaaagttacgccggcaaatttatcacaaggtgttaaccttttcgagcaaggagatgtctgactttggtgattcgtctttaatcactaggtcgactaacgacatcgtccaggttcaaaacgtgatggttcagtttttacggatgatgattcaatcaccgatcatgttggtggcagccatcatcctggcttaccaccgcgagccgcgcttaacgggagtttttgccatctccttgccggtccttgccatcgtggtaattggggtgatgtactttgccgttccgctctttaagagtattcaaaagaagaccgaccggattaacctggtctttcgggaaggcttgaccggggtgcgagtaattcgggcctttaaccaggaccagcgggaacaagaccgtttcgaaggggccaacgccgattacaccaacaccgggattaaggccttcaccctggtttcgttactcttcccaatcatgactctaatcctttccctaactaacattgggattatctgggtgggagccaagttgattgctaacatgagcatgcaagtagggaacctgatcgcctttatgacctactcgacccagatcctgatgtcctttatgatgctgtccatgctgtttgtctttattccacgggcctcagcttcagctgcccgtttaaatgaagttttagatcggcgccctagcgttagtgaccccacgccggatgaacaactgagtgtggttaaggacgcaccagccagcctaacttttgatcacgttaacttccgttatgaaggagccgaggaactggccttgaccgacctgaactttaaggttcaagccggacaaaccctagccattatcggggggaccggttcgggtaagtcctcgttggttaacttaattcctcaccttttcaacgttgaaagcggacggattgaggtcaacggtcaaccgatcgaccgcttgagtcaacatgatttacaccaagaaatctcgatcacccagcaaaaggcggtcctctttaccgggaccgttcgttccaacctgcagtttggttatgaaacagcgaccgaagacgatatgtggcgggcactagagattgcccaagctgccgacttcgttagagaagaggggggcttagataccatcgtcgaacaggacgggagtaacttctccgggggacaacgccaacggctggcaattgcccggacaattattaaaccggcttccgtatacatctttgacgactccttttccgcactagacttcaagaccgacgctaagttacgccaagccttgcgcagagacccgcaaattcagcgcgccgtatcagtaattgtggcccaacgaatttcaacggtggccgacgccgaccttattttagtggttgatgacggtaaggtggtcggccaagggagtcacgaagaactcaaggccactaataagacctaccaagaaattctgcactcgcagattcaagagggggatgaagaacgtgcacaacggaaatagacaccaaaaagacggcgccaaggtacaacacttttggaagacgacgggccgtttgctcacttatttgaagccttggaagtggggcgtgattatttcgatcctggttgcgattgcgtcggtggtctttcaagtgatggcccccaaggtgttaggggaggccacaacggttatctataatggcgtcttgaagggggcgtctgaaatgaagctggggatgcacctaagcaagtacccgattgacttcactaagattggccaaattgtgatcgctgttttagtgatgtacgcattgtcgggcttattttccttcgtccaacaagtgatgatgacccggatttcgcaacgggtggtttaccaactacggcaggattttaagtctaagatgtcccggttaccagtctctttttacgacacccatcccaacggggacatcatgagccggatggttaacgatatggataacatctccggtaccctccaaaacgggatgattcaaatcattacttccgccctgaccttcgtgggggtattggccctcatgatttcgatctcgtggaagttaaccttagtcgccctaattaccgtgccattatcgttagtgattattggctttgtggcaccaacggctcagcgcctctttgtccggcagcaggcggtattaggtaagattaacgcgcaggtggaagaaacttacgctggccacacaatcgtccggacctttaaccgggaagcggaccaagaagcgcagtttgaagaaaaaaacaccgcctactaccaagccgcttggaaggcccagttcttctccattttgatgtacccagcgatggcctttgtccggaacctgggttacttgatggttgcggtggtcggggcgttgcaagtggtgaacggccagattaccctggggaacgtccaggccttcttgcaatacaccaatcagttctcgcagccaatcacccagattgctagcctggcctcgaccattcagcagacgatcgcctcagcggaacggatttttgaggtgctagaccaagacgaaatggacactgacttggctgatcaaaccgtcttgccggggccacagcccaaagttgagtttaaagacgttaactttagctacgatgaccagccgttaattcaagacttcaatctcaaggccgagcagaatcacatggtggcgattgtggggccaaccggggccggaaagacgacgattattaacctcttggagcgcttttacgacgtcaagggaggccacatctatttggatgggcgcgatacccgttcctttacgcggccggaattgcgcaagaagattgccatagtgctacaagatacctggctgtttacggggacgatttacgacaacatcaagtacggtcgtgaagatgccactgaagaagaggtctacgcggttgccaaacaggcccacgccgataccttcatccgtcaattacccaatggttaccaaaccgtattggacgaatcggcctccaatatttctcaagggcaacgccaattgctgacgattgcccgggccttcttggccgacccggaggtcttaatcttggatgaggcgacctcgtcagtcgacacccggaccgaagaggcgattcaagacgccatgaatgacatccaaaaggggcggaccagctttgtggtggcccaccgcttgtcaacgatccgcagcgccgagcaaatcatcgtgatgaaccacggtcaaattattgaaaccggggaccacgatagcttaatggcaaagggcggtttttacgccgacctgtacaacagtcagtttgccggcaatcagatttaaggttcaatttaaaacacccccgttcggaagccaaaatgggcttttgtacgggggtgtctttggtataatgggtgaaaagtaagggggaagttgattgcaaacctatcaaacaacgcaagcgcagttacgggcaatggtcgacgacggggtggtccccggcatgtcttattgcctctttgaacgcgactggcaggtcgaagccgttcgggggctagcgcaaattgaaccgactccggaatggttacgccctgggatgctttatgacttggcttccctaaccaaggtggtggcaacggtaccggtgatcgccatcctcttacaaagcgggcgcctgtctctggatgacccggttagtaggtacttaccggagttttcaaacgaccaggttaaaatctaccatttgctgacccattcgtcggcaattggtggctacattaaaaatcgtgatgaccttgatgctaagcagttaacaaccgccctgttaacgaaccagactagtggggttaaccgggaccgcttgattcgctacgccgacgttaacttcatctacttaggctggattgccgagcgcatcttggggcaaccaatccacgtgttggcgagggagttggtctttgcccccttacagatgacgcaaatcaccgaccagccggtagccacccaaacggtgccgacgagcattgaccagcggcgggggctcttgcgcggtcaagtgcacgaccccaagggagcggtgttagggagccactgcgggtcggccggcttttttgcccccctcactgacttgattacctttagccgggccctggtggggactaacctggccggcctgttgaccgaacaaaccatggcgcagctctttagcgatcaaaccagaatggtcagcccccacctccgtggcttgggctggaagctggtcccaaacccagccacccaccgttttttgattagccacactggctacaccggaaccctcttagtcttagaccgtgatcacgaccgggggctaattatgctgactaaccgggtgcacccgcgggggcaaaacaaccgctacttagaccgccgcgatcaaatcattgctacataccttcgtgaaatgggagaaaattaatgataacttgggataccattcgctacgtaattgaaactatctggttaattaacctagccctggccttttggacggtctttcgggagcgccgggacatcgcttcaacctgggcctggctgttggtcttatcctttttaccggtggtgggctttgtcgcctacctcttcgtgggccgcaaactatcgcacgaccagatcttcaccatccaagacgaacaacggcgcattctagaacagtacaagcaccaacaacagcgcctactggaggcccaaaagctcctgcctaaagaagagcaatcgcgtagggatcagatgatggccaacctcttgttaaacaccgacaacgccctgctaacctttggcaaccaggtacatttatttacggacgggcacgctaagttcgatcagctcatcaaagacattgatcaggccaagcggcacatccacgttgaatactacacctttgcggccgatcaattaggtcatcgggtcttggcggcccttgaacgggcagccgagcgtggggtggaagtccgggttctttatgacttgtcggggtcgcgcgggaccacttaccgcttctttagtcaccttgaagaacttggtggccaagctcaggccttcatttctagcgctaaggctcgtttcaacaccccccgcttgaattatcacttgcaccgtaagttggtcatcattgacggtgacctgggctacattgggggctttaacattggtgatcagtacctgggcgagtcgccaaagtttggttactggcgggatagccacctccgggtcgaggggacggccgtattgatgatgcaagcccgcttcatcatggattggaacacgacttgccggcggaccaaaaaggagcggatggatctggcgggtgattacgttaacgttcgaaccacccggctaaagaatccggatcggtcaatggttccgatgcagattgtttcgtccggccccgataacgataaccgggcgattcgtcgcggttaccaagggatcatttcctcggcccgtcactacgtctacattcaaaccccgtacctaattcccgatgacgcaattttagagtcattagtggtggcggctaaatccgggatcgacgttcggatcatgatcccgccgatgccggatcacccctttgtctaccgggcgacggagtactttgcccactacctagtttccaacggggtgaaggtttacaagtacgataagggctttttgcacgccaagaccatggtttccggtagtcacctggcgtcggtcgggtcggctaacctggattaccgttccttccggcttaactttgaggttaacgcctttacttacaacgagcagttggctggtgaattgaaagcggcctttgaaaacgatctaaaagactgcacccaactgaacgaggagtacttcgaccagcaatcagcttggcggaagttcaaacaggacttctgccgcttgctcgccccaattttgtaataataaaggccaggagaacatcatgtttctcctggccttttgttgtattcgcaaatgttagacagataacgtgctcccaaccacgggcctagtagctaagtacgggtgaagaacggtacgtgccgcaccaaccttccccctagcttagctatacgacccgaatcagaggttggtcgcacttccaataacgtactctccaaccgcaggcctagtggctaagtctgaccggagaacgatgcgtaccgcaccaacccccgttctatccttagcccacggcctgcttgataggttggatcgcactcacttttaactatttttgattttggttttgaggtggtccatttccatcaccacgatcgtttctaacagggtgatgatgcaaactgccagaaaggaccagttacctggggcaacgaacatgaagatgattaacaaccacgatccccaactccagcggttgtcgatccggacaatccggcgaattcggccctctaattcggcgggggcctcatcgttggccagtagtccacgtaagtacagttggaggcggacttcaaagaatgactcgacgataaaggcgatcaccatgagggtggagagtgaatttaacattgcgccaccccctaaaaggttggttggacgattagcccctcttggggtgtcagatcggcgtcgggatacttaatcgaaagggcttcaagtaacatttgcttagctagctcaccgttgcgggtgaggattggcccgtggaaataggagcagtaggtgtgtaagtaaatggccccttccgtgccgtcctcgccgttattcccgtggcccgctaagacgtgccccaaggggcgctcattttcacccaggaaggtccggccgttgtggttttcaaagccgtggaacttagcaccggtgtcttcattttgaatctcgacgtcgccaatgaagcgggactggttttgctgggcggaccggtgctcactttgggttaaggtgtagtggtccaaaaccccgatgccggggatcttttccccgtcggcccccacgtagtacttacccagtaattggtagcccccgcagatggcgagcattggtttgccgtcctcaataaactttttgatcccgtcctttttggtttggatatcttttgagaccaccatttgttcgtagtcctgacccccaccgaaaaaggcaatatcaaactgatctggatcaaagtcgtcttcaattgagaccacgtcgacttggatatcggtatccatttgcttagcgtagtacttaagggcgatgatgttaccaatgtcgccataggtgtttaataggtcgccgtacaagtgggcgaggtgtaagtggtacttagccattaatccatccctccttgaatgtatttcttgtcggctagtagtttgcgtagttgcaagaccgccgtgtaggtagctaagaggtacacgtgcttagtaggcatttgcgggatcttttcaattacttggttgaggtccggtaagtgatcgatcttgtcaattccagccatttccatccgggtggtaatgtctttgtagcgctccccaccggtcatgaagtaggggatatcgtggtcgtggaggcgttcaaagtcgccgtcccagatccaggaggtgtcgatcccgtcggcgtagttggcgtttaacaagaagccaaacgagaagggctccggatcggtcaaaatcatgtccaggacctggtttaagcccaccggattcttgaccaaaattaaggtaacttccttgccgtcaacgttgattacttcttgacggccaaaaacccgttcgtcggcgctgaaggcgtgttggatttgggccgggctaacccctaggaaacgacctaaggaataggccgctaaggcgttataaatgttgtacagcccgccgatttcaatctgataggggatcccatcgatttcaaaagaagaggaggtcggggttaattcactaagtttagtgacctggtaagtcagttccggacgtttaaagccacagtgggggcagaagtagtcgcctaggttggcgtaggtccgtaagtggtagtgcaagatgtggtggcacttagggcacaagagtccatcggtattagccggcgccttgaaatccgcgtgggattcgtggttgaaaccgtaatagatcacggggtttggcagctccttagtgttgaagatctgctcgtcaccgttagcgatgatggtggccttaggggctaacttaaccccggctaagatcttatcgtaggtcgtgtagatttcgccgtagcggtccatttggtcccggaacaagttggtaaagacaaaggcgatcggggtaatgaacttagtgaccttgacgacgtttgcttcatcaacttctaagaccgccaagcccttttgcttgggccggggcgccgtgatgaaggtggtgacgattccttgttccatgtttgaaccggtggggttggttaaaacggaatcgtacttttcccgtagcacccggacggagagggcggtggtcaaggttttcccgttggtcccggtgaggatcaccaggtcgtatttcttactgaaggcttgtaagatgttgggatcgagcttggtgacaatcttgcctggtaatgaggagcccccgtgggtaaaggtgtggaggaaccagtaactagaccgaccggcaaattcggccagcgaacttcttaaagacataattcatatccttccgcttgcgtgtattgattaccgattaattttaatcgttccgggcccaaaaggaaagtaacctccctcaccaagtcatgctagcggcgtgggcgaaaattatttttcaatgaggaaagagctaagcgagccgctttcatcacgattagaccggcaataagcatggttaactcaagaaaacattggctaactggggggagaagagtttaaaacgggcccaagatccgctataattaaggcactatgcgaagaaatgggtgagacaggtggcgcagttgttctttaagtacggcgcaatgaattctggtaagtcaattgacattctaaaggtggcccacaattatgaggagcagggcaagccggttgaattgttgacgagcggaattgatgaccgggccggcactggggtgatcgccagccggattggtttgaaacggcgggtcacgccgatcatggaggacaccgacgtttttgaactgatcaaacaaatcgatcaccggatttactgtgttttgattgacgaggcccagttcttgagtaaggcccacgtactgcaactatgccacgtggttgacgacctcaagatcccggtgatggcctttgggctcaaaaacgactttaaaaacgagttgtttgagggatccgaggccctgttgatctacgccgataagattgaagagatgaagacgatctgctggtttttcccccgcaaggcaaccatgaacctgcggattagcgatgggcacccggtttaccaaggcgcccaggttcaaatcggcggcaacgagtcctactacccggtttgccgggaacactattttcacccagatttgccaagtgaacaggagaatgagtaatggaaatggaagaaattttcgataagttacaagccgtggccgaccgctacgatgaacttaacgagttgatctcggatcccgaagtaatcgccgactcccaacggttcatgaagctctcaaaggaagaagggagcctacgcgaaaccgttgaaaaatacaacgagtacaaggaagtcacccaaacgattaaggatgacaccgagatgttgcgcgaagaaagcgaccccgacctggtggaaatgaccaaagaggagcttaatgaagccaaggaacgccaagcccagctccaagatgaactggaagtcttgttaattccaaaggacccgaatgatgataaaaacatcattatggaaattcggggggccgctggtggggacgaagcctccctgtttgccgccgatctgtataacatgtacgttcgctacgccgaaaagcaggggtggaacgttgaagtggttgaccgcaacgaaaccgaagtcggcgggttcaaggaaatcgccctgataattaccggtgaccaggtttactccaagctgaagtttgaaaacggggcgcatcgggtacaacggattccggcgaccgaatcggcgggccgggtgcacacgtcgacggcgaccgtgggggtaatgccggaagccgaagacgttgacgtggacctggatccaaaggacatccgggtcgacgtttaccgctcttctggggccggtggtcagcacattaacaagacctcctcggccgtacggatgacccacctgccaacggggatcgtggtggcaatgcaagacgagcgttcccaacagcaaaaccgggccaaggcaatgcagattttaaaggcccgggtttacgattactaccaacaacaagaacagtctgaatacgatgcccaacgtaaaaacgcgattgggaccggggaccgttcggaacgaatccggacgtacaactacccgcaaaaccgggttaccgaccaccggattggcctgaccctaaacaagctcgataagatcatggctggtgacctagaagaaatcatcgaatcgctaatcattgccgatcaggcccaaaagctggagcaattacgcaatgagtaataattggacctactttcaagcccagcgatgggcttcttcttttttaggggaccatggtaaggatccatcagcggcgcagtttattttggaaatgctccacgactggtcgatgaccgacctgttggccaataatcgtcaaccgatgcccgtagaagaagccacccgctaccaacgggcgatcacccgggttgccagtagcgaaccggcccagtacgtggtcggcaaggcgcccttttttgggcggaagtttgtggttaaccgggacgtcttgattccggaaaccgaaaccgaggagttggttgaatgggtcctggattcgatgccggcggataaggaactcaaggtgttggacctcggaaccgggagcggggtaattggtattaccctggccttggagcgccctaagtggcaagttaccctgagtgacatttcggcggccgccttgaagatcgccctgactaaccaacgcttgcacgggaccaacttaaaccaagtcgaaagcgacctcttcgcgcggctaggggaccagcgtttcgacctgatcgttaccaaccccccgtacgtcgcgctaagtgaaattgacgagatggatccggaggttttggagtacgaaccgccgctggccctgtttgctagtgagaacggcttagccttttaccgccgtttgtttgcggccgccggtgagcacttaacgccccggggggtcctgtttggtgaaactggtcaccgacaagaagaacgaattcagcagctattaaaggaactggcaccgagcgctaaaattgagacccgtcacgacattgcggggcgaatgcggatgattaaggtgacagactttgattagataagaaggggaaagataatggtgaaaacagtcatttttcaaccagcggaagtaaagcaagcggccaagttgatccaagcaggtcaactggtggcctttccaaccgagacggtgtacggcttgggggccgatgctactaacgaggaagccgtcaagcaagtctacctagccaaggggcgaccgagtgataacccgttgattgttcacgtttcctcgttagcgatggttgagcactttgccgcagaaattccggcaaaggctaagcaattaatggatcgcttttggcccggttccttaacgattattttacggttcaaacccggcaccctttctaaaatggtcactggtggtttggatacggttgcctttcgtttccccgattgccagcccaccctcgatttgattagccaggcgggggtaccgatcgtgggcccgtccgctaacacctcggggaaaccgagtcccaccacggctaaccacgtctaccacgatctaaacaacaagatcgccgggattatcgataacggtccgacccgggtgggggttgaatcgaccgttttggatatgtcaacgagccaaccggtgatcttacggcctggagccgtcaccaagcaagacattgaaggggtgatcggctcaattgacatcaaccatcaccaagtcaaacaagatgaggttcccaaggcgccgggaatgaagtacaagcattacgctcccaacgcccaggtctacatcgtcgatcccgctgatgattggggagaagtagcggcggtgatcgcccagtcgaaggagcaggtgggcttaatggctaccgaccaagtgcttcacgcccacgtttggtcggttcaggccgatcaattctccctggggacgggagtgcaagaggccagcgcccatttgtttgaggggctccgggactttgataatcaagaagagatccaccaaatcttttgccaagggtttgaaccgaccggactgggagcggcttacatgaaccgtttgaataagtcggcgggtggggcccacttccgggatttgctcaataaataacgcatgtaagccagaccatcccaaaatggttcggcttttacgtacgtttataaaattaacctttcaatttaaacgtaattaccgtacaatatgggtacgcaagtgaaaggagcaattaagctaatggaatatgcaggtaaggacgcccaactttgggccgcaatcggacgcgaagaacaacgccaagaggacacgattgaactgatcgcctcagaaaacattgtttcaaaagaagttgccgccgcacaggggtctgtcttaaccaacaagtacgctgaggggtaccctggcaagcgctactacggcggttgccaatttattgaccaggtggagcaactcgccattgatcacgctaaggaactctttggcgctgcctacgctaacgttcaaccccactccggttcccaagctaacatggcggtctaccaagcattattaaagcctggcgacaccatcttggggatggggatggacgccgggggccacttaacccacggttccaaggttaatttctccgggaagctttaccacacctacggttacgaactcagtcccgaaaccgaggaactggattacgacgccatcctggctcaggctaaggaaatccaaccccagttgatcgtggcgggagcgtctgcttacagccaaatcatcgactgggacaagttccgccaaatcgccgatgaagtgggtgcttacttgatggtcgacatggcccacattgccggcctggtggctacgggttaccacccgaacccggttccggttgccgacgttgtgacgacgaccacccacaagactttgcgtggaccacggggcgggatgatcctatccaagtctgaagaactaggtaagaagtttaactcggccgtcttcccgggtacgcaagggggaccgctggaacacgtgattgccgggaaggcccaggccttttacgaagacttacaaccagcctttaaggattacattggccaagtggtgaaaaacgccgcggctatggcggaagtgttcaacgaatccgaaacgatccgggtggtcactggtgggacggccaaccacttgttggtccttgacctaacgaagaccggcttaaccggtaaggacgcccaggccctgctcgattccgtgatgatcaccactaacaaggaagcaattccaaatgaccaacgcagcccgtttgttacttccggtctgcgggtcgggacgccagctatcacctcgcgtggctttaaagaagacgacgccaagcaggtggccagcctgattatcaaggcgttagacaacgctgacgaccaaaccattttggctggagtgaaagaagccgttcacgccctcacccaggcgcacccggttgactaactgaagaaaaccaattagtaaaaccagtcccctaatcaatcagttggcattgaattaggggactttttgcgggccggaccattgatggacggcgccccgactggtacaatagcaaagaaactaaaaggagtgttttgtcatgggtaaatttgaggtgctggatcacccgctaattcaacataagttaacgatgattcgcgacaagcgggtcggaacgaaggtcttccgggaaacggttaaggaaatttcaaccttgatggcctacgaagtttcccgtaacatgcccctaaaggacgttgaagtggaaacgccaattgccaaaaccactcaaaaggaattggctgggaaaaaggtagccatcattccgatcttacgggccggcctggggatggtcgatgggatgaccgaattgatcccagcagccaaaattggctttattgggatgtaccgggatgaagaaaccttgaagccgcacgaatacttcgtaaagttgccaaacgacattacggaacggcaactcttcatcgttgacccgatgcttgcgaccggtggatcagccgtaatggccatcgaagccctaaagaagcggggctgccaagaaaagaacatgaagtttgcctgcttagtagcggcgccagaaggggttaaggcggttcaagaggccttcccggatgttgatatctacacggctgggctggacgaacgcttaaacgaagatggttacattgtgccaggcctcggggacgcgggggaccgcctcttcgggaccaagtaggtttgcgactgtttccgtaatttgtgtctaatattcgtgaatacagcaagaggcgaggggggaaccatgttttctcctcgcctctttaatttgtctaaagttcaaaataagctaaagcttttcataattcagtcattattgccggggcccgcgctacaataggggacgtgattttaagcaaaggatctgagattatgtggaaaactgggtggtggaaggcgaagtataaactcgtcatcgccctaattgtactcggggtgggagcgatgatcttcacaacccataaccagcacttgtataaggccccgttggcccaagtggtggccgttgaaaacgggaaggcgcaaaaggaaactgacgagttccaaaatgtcgactaccaggttaaccaaacgttgaccgtcaaaatgttgaacgggaaatacaccggtaaggagtttaaggtgaacaatacctacaccaagtcgggggccctggaccaacgttattacccgggaaatcaaatctttttgagccagttgacaaagcgaaatggccacctgacggctaacgtggccggttacaagcgtgacgtggtcttagtatttttgggctggctagtgatcttcttgctggtcttaatgatggggtgggccggcagtctggcgatgttaagtgtttgcctcaacgccgtcttgttctacttcgtcattcaaattgacctgaagatgcaggcgagccacgcctttttgaccttttccattttagccctgctctttgcggccctctcgctcttgttggtgcttggactgactaaaaaaatggtggcgacctttttagcgaccgttttggggacttcggtggcaatgttggtgtcggtgctggtgatgaatttgactcaccaccagggaatctattacgaatcgatgcaatacgttacccaggtcccgcggcccctctttttggctgagaccttactggggtctttaggggcggtaatggatgaggcgagtgacatcgtagcgaccctacacgagttacacgagattgacccgacgatcagtcgccggcaactcttcttgtctgggcgcaacatcggcaagtcaatcatgggtcccctcgtgaacgtcttgttcatgatttttatggccgatacctttacttcggcccttctctacattaaaaacgggaataattggggctacaccttttcaatgaacatgagcttggggaccgttcaaagtttggtatccgggatcggaatcgtcctagcaattccgttagtatcggcctttgccgcgctcttgtacgggagaaagggggaagcagcatgagttcaattaccgctctggggctggttttgatgctattgatgattgccgtggggggccggcaaggctggtccgcctttttatcgttgctcttaaactttggtttcctcttctttgccatcatcctgatcgcctttcacgtcccgccaatgatggtaaccctaatgaccggggtgatcatcttagcgattacgatctttatgggcgaagacgatttacgcaccaccgtgaccgccttttgggcctcagtggtggtcctcttggttttggtggtcttaatctacttggttgagcactgggcgatggcccaagggttcggcctggaagacagcgacgacttggaggggatgtcaacggcaattggaatctcctatttaaaggtgatcatcaccacggcggccctgtcaacgctaggggcgattgccgaagcggcgatggcgattgccgccgggctaaccgagatcttaggggagcaccccgacctgtctgataaccgcctcatgcaaagcgggatggagattggtaagcagattatcgggacaaccttgaacacgctgttcttcggtttctttggtggtttgttggccctcttcatctggtttgccgggcttaactactcctttgggacgatcgttaacgataagatctttgtcagcgagatcatcgccgttttgatttcctttatcgccgtgatcgtgaccgtcccggcctcgacgatgatcatgatttggcaaaagcaccgggggattgacaaggacgaggtcgtcaagtagaataggaataatttagtgagtcctttaatggaatcccgtgaggttctaaagggtcggtcaaatcgcgaataattcgtgccgtgcgcctttggaacagtggatgtccaaaggcgtttttgtatggaggaagaaaatggaagagaaaagacgggacgtcgtcttagacgttgatgaacgccctggcactgggcagtggattggactgtccttacaacacatgttttccatgtttgggtcaaccgtgttggtccccattctggtggggttaaacccgggaattgccctgtttagttccggggtcggtaccctgatgtacctgttaattactcgccacaagatcccggcgtacatgggatcgagtttttcctttatcgtgccgatgatggcgctgatgaagtcgacgggctacccagggattgctcaggggacgatcgccgttgggtgcgtctacctgatcgtgtcgttgatcgtttcccgcttcggttcggcgtggattgatcgtatcttgcctccaattgtggtgggaccaattgtaatggtaattgggttgtccttagccgccaccgccgccaaggacgccaccatgaacgggagcacttacgacattaagtactttatcgtggcgatgttaaccctgttgatcacgatcatttttaacatgtttttcaagggcttcttaggcttaatcccgatcctcttggggattgttggtggttacatcattgcctgcctgtttggaatcgtgaagttcagtggcgtaatgtccgcccactggtttagtctgcctgcctttcaaattccgtttgttaactatcacccgcagttttattggggcgccattttatcaatggccccgattgcctttgtgacgatgactgagcacatgggccacattatggtcttaaatgaactgaccgaccggaactactttaaggatccggggttaaaccacaccctggcaggggacgggacggcttcgatcatcgccgggtttgtcggggggcctccggtaacctcttacggtgaaaacattggggtcttggcaattacccgggttcactcggtatacgtcttagccggggcggcgtcctttgccatcctcttctcctttgtggggaagctatcggccctgattgaatcaatcccttccccggtgatcggggggatctccttcctcttgtttggggtgatcgcctcctctgggctccgggtgatgattgaagaccaaaccgactttaacgaaaagcgtaacctgatgatctcttcggtgattttggtgattgggatcgggaacgcgtacctgcaactgggccaatacgaattctctggtttggcggtggccgccgtcttggggatcgttttgaacctagttctcccacaaaaagcggctagcgaacgctaaactgagtaacaattcacaaaaaaagattggagctgcacaagcggggccaatctttttttcgttaacgacaattaaagccgttatgatacggatttagggtctttcaacatgtcaaactaataaaaatttaatcaaagggaattggaaagcaaaagccgcttaataattgagatggtgccggtttcaaaagtttgaaattgctttgaattctaaattaaagaatgctatattagtctttgtatattgggtttagtggtgattttgttcgtccatcagctcattaatacaaaccagattatgttataaagaaaagaggtggaatatagatgggcggtgatgcgttcacttttgaactattcggcctgaccttcaactggaccaacttgatctccggtacgatcgtcttcgtcattaccttcttcctgttatttgggttgtcaaggcacctgcagatgaagccaaccggtggccaaaacgtcttggaatggatcgtggaatttacgaacgggattgtgcgtggacaaatgccttcagaaacgagtggtttttacagtttctttgtatttgtcttgttcgtcttccttttcatttccaaccaacttggtttgatcattcagttcggctggaacgggcatgaaattgtcaaaagtccaaccgcagatccggtagttaccatgacgcttgccttgtgtgccgttacgctgtcacactttgcgggggtcgctcgacaaggcgttaagggttactttgcggactacttcaagccattctcacttatgtttccaattaagttggttgaagagtttagtaacttcctaaccttagggctgcggatctttggtaatatttatgccggtgaattactgttgaaattacttgctggaatggcgttctctcacgggattcctacgatgatcgtgagcctgccactagaaattatttggcaaggcttctcagtcttcatcggggccattcaggcttatgtctttgtaacattaacgacggtttatatttctcggaaggtaaccggggaataaccacatatctttaaggaggatatatacaatgggtgcaattgctgcaggtatcgctgctggtttagctgctgtaggtgcgggtgttggtaacggtcttgttatcggtcacacgcttgatgggatggctcgtcaaccggaaatgtccggtcaactgcgggggacgatgttcctcggtgttggtctgatcgaagccctgccaattctttcgatcgttattgccttcctggtaatgaacaagtagttaatcgtttaaccaaaaaattcattacaagggaggtgtcaatagatgtttatcattgcggaatcaaaccaactgtatcttggtgacatgctcttctacctggtctcatttctgatcatggccgccctcgtttggcacttcgcttggaagccagtgacccaaatgatgcaaaagcgggctgacaagatcgcaaatgatatcgatagtgccgcacagtcgcgtgaagaagcccaaaagctggctgctaagcgtcaagaagaactaaagggttcccgccaagaagctgccacgattattgacaacgcaaagcaggctggtgaaagccaacgtgcggaaatcatcgccacggctcaacaagacgcccaaaacctgaagaatcaggcccaaaaggacgctgaacaagcccggcgagacgcccttcgtggtgccaagaaagatatcgcaaacctgtctattgagattgcttccaagctcatccacaagcaattgaatgcggatgaccaacaagctctcattgacacttacattgaagggttggtaaagcatgagtagacttgaccaaaagacggttgcaaaccgctacgcccgggccatctttgagttagcccaggaagatggtcaactcgatcaaacttatcaagagcttgtcagtgtccgccaggttttcttagacaacccaagtctcgccccactattagccggggtggaccttggcattaaggaaaagcaggccctagtcgaccaggttaaagaaggggcaagcaagtacgttgccaacctcttgcaaatggcctttgactaccgccgcatgagcgacatggttgcaatcgtcgatgagtttgaacggcggtatgatgaaaagcacaagcgtgttcatgccgaagttgtgaccgcggtgcaacttgatgaaacaagaaggaatcaactgagggacaatttggcggctcgcctcggcgcccaagaaatcgtcttaaatgaaaaggttgatccaacgatcttagggggcgtggtggtaaaaaccgctaaccaaaccctcgatgggtccatcaagaccaaaatcgaacagatacggcgtttaattgttaagtaacagtgaacttgaagaggtgagatttgtatgagcattaaaactgaggaaatcagttcactcatcaagaagcaactcgccaactaccaggaccagatttccgttgaagaaaccgggacggttacctacgtaggtgacggggttgcccgtgctgatggcttggaaaacgccatggctggtgagttgctcgaatttgaaaatggtgtctacggaatggcacaaaacctcgaaagtaacgatgtcgggatcgttattttaggggatgataccgcaatccgtgaaggtgataccgttaagcggactggtcggatcatggaagtgccagttggcgatgccctgttaggccgggttgttgacccactgggtcggccaatcgacggtctgggggacatcaagaccgacaagacccgtccaatcgaacgtaaggccccaggggtgatggaacgtaagtccgtttcccaaccactgcagaccgggattaaggtgattgacgccttagtaccaattggtcgggggcagcgtgaactgatcattggggaccggaagaccggtaagacctccattgccatcgatacgatcattaaccaaaaggaccaagacatgatttgtatctacgtggcgattgggcaaaaggaatcaaccgtgcgttcccaagttgaaaccctgcggaagtttggcgccctcgattacacgatcgtggtttccgcttccgcttctaacccagcaccattgctgtacatcgctccgtacgcgggggcagcaatgggggaagaatttatgtttggcggccgcgacgtcttaatcatttacgatgacctgtccaagcaggccgacgcctaccgtgaactgtccttgattttacgtcggcctcctggtcgtgaagcatacccgggtgacatcttctacacccactcacggctgctggaacgggcggcacggctctccgatgaccttggtgggggttcaatgaccgccctgccagttatccagacccaggcaggggacgtttccgcctacattccaactaacgttatttccattaccgacgggcagatcttcttggatgccgactccttctacgctggtcaacggccagccattgacgccgggacttccgtttcccgggttggtggggacgctcagatcaaggcgatgaagaaggtttccgggacgttgcgtcttgatatcgcttcttataacgaattagcggccttcgctcagttcgggagtgacctagacgccgccaccaaggcccgcctagatcgtggtgaacggacgatggaagtcttaaagcaaggcctccacgccccacaaccagttgaacaacaggtggttaccctgtacgcattggcacacaactacttggacgatgttccggtagacgacgtgttacgctttgaaagcgaacttgcgaccttcatgcgttccaaccaccaagacctttacgattcaatcaagcaaagcggtcaactccctgatggcgacgggctcgacaaggccctcgacgccttcaaggctggttttcaaactagtgaccaaaagcaagatgcatccgtggcccaaaactaacagtgaccagtagaaaggacggtgagatttagtgccagcttcattagctgctgttaaacggcggattcagtcaaccaagagtacgcgccagattacctcggcgatgcaaatggtttccactgctaagctcaatcagattcagcaccacacgaagacataccaggtttacgctgaaaaggtgcaagccattttggtcagcctggttaaatctcatagcgccgattcactgaagtacgaacaagactcctctttgggggacttgttctccaaacgtccagtgaagaaaactggcatcctcatcatcacgtccgaccggggcttggtgggttcttacaacagtaacgttatcaagtccaccctcgacaagatgaaagaagacggccttaacgcagacaacacggtctttttgaccgttggacggaccggcgccgagtttttcaagaagcgcgggatgaacgttgcctacgaatttacgggtgtcagtgacgtaccaacttaccgggaagtacatgacgtggttaagcaggcgatccaactttaccaggatcaagtctacgaccggctgtacatctcctacagccactacgttaaccggatctcctcgcaggaccggaccgaacaaatgctaccgatttcagcggatggtttacgccaaaccgaacaggaaattggtaaccggacggccggcgatggggttccgcttccggcaagtgagtatgagattgagccttccgatggtggaatgctcgatatgcttgtcccgcagtacgcggaaagcttgatttacggagcgattctggatgctaagacgtccgaacacgcctccagtgccaacgccatgcgttctgcatctgacaacgccgatgacattatttcgaccttgcagttgcaatacaaccgggctcggcaagcggccattaccaccgaaattacggaaattaccggtgggatgacggcccaagaatgattctgaatacaggaggaaacacatgagtactactggtaaagttgttcaagtaattggaccagttgttgatattgagtttcccttggacgagaagttacctgaaatcaacactgctttaaagatccaagaagccgatgacaagacgttgacggtcgaagttgcccttgaactgggtgacggcgtggtccggacgattgccatggacgggacggacggtttgaagcgggggatggctgtcgaaaacaccgacgcctccatcagtgtaccagtgggtgacgacaccctcggtcgggtctttaacgtcttaggggaacccgttgataacggaccggaatttggtccggacgcacagcggatgccaatccaccgcgatgcaccaaagtatgaagacttgagtaacacgacggaagtgttggaaacggggattaaggtgattgacctcctcgccccatacgttcgtggtggtaagattggtctcttcggtggtgccggggttgggaagaccgttttgattcaggaattaatccataacattgcccaagggcacaacgggatttccgtcttcacgggggttggtgaacgaacccgtgaagggaacgacatgtactacgaaatgaaggcttccggggttttggaaaagacggccatggtttatggtcagatgaacgaaccaccgggtgcccggatgcgggtggccctgaccgggctgacgattgccgaatacttccgggatgttaagggtcaagacgtgttgctctttatcgacaacatcttccgcttcacccaggccggttcagaagtttccgccctcttaggtcggattccttccgccgttggttatcaaccaaccctggccactgaaatgggtcaactccaggaacggattacgtcaacgaagaagggttccattacctcaatccaagccgtttacgttccggccgatgactacaccgacccggcgccggctacgaccttcgcccacttggacgccacgaccaacttggaacggcgcctgacccagattgggatctacccggcggtagacccactggcttcaacttcgacggccttaacgccagaagtggtagggcaagaacactacgaagtggcaactggggttcaacacgttctccagcgctaccgtgaattacaagacatcatctcgatcttagggatggacgaactctccgatgaagaaaagaccatcgtggcccgtgcccggcggattcaaaacttcttatcccagagtttcgccgttgccgaacaatttactggtcaaccgggggcttacgtgccgctggaagaaacggtgaaggacttcaaggccatcctcgatggggaatacgacgacctgccggaagaagccttccgtttggtcggcgggattgacgaagctgttgccaaggcaaagaagatgcaggcggatacggcagctgaaggttaggggggtcttaaatggctgagaatacttttcaagtcaccatctccactcctgacggaatcgtctacgacgggaacgcaaccatgttggtaatgaccacgacgggcggccagctcggtctgatggccaaccaccaaccgttaatcgcctcgttagccatcgacgcgctgttgattaagcaccaagatagcgacaaggaagacgaacgggttgccgttaacgggggctttatcgagttccacggtaacgtagcaacgattgcggcctcaagtgccgaattacctgaagacattgacgttgcccgggcccaaagtgctaaggaacgctctgaagcattaattaaaaaggcacgggaagctaaggatgctgacgccctcgatcgagcggaagttcacttgcggcgggccattaaccggctgcaccttagcaggaagtagtctatcggggagtgggaaccaacttttatgactgcttacacaagcgctcattagttggttaccgcgttatctgtctaacagcgacaattgaaaagaccgggagaaagtaaaatttcttcccggtctttttagtttccccaccttttatgaccgctaaaaatttagttaagcttattttttggtttcggttccggtggtgagctatggtatgatagccattgtatgaggtgattgaatggcggagttaaaaacttttattacgctaattgtccaaattggctttattttgattgcctttcgtgcgattaaaagcatcgaagtcgagcgcttctttcgccaaccaccggcgggcttacccctgctgatcgttttagtggcgattgcgatcgggtacgcgtgcgcgagtttctttactaattttttcacgaccctatcaactattttggggtcactgtaagggggattgatggtgcggatcagagttgaaaatggggggcgactaagtgggacggtaaccctggcgggcgatccagaagcggtggtcgccggtcaagcggcggccctactgtcgtcacgggggaaggttatcttagaccaggtccccttagcaaacgagcgggtaacgttagggacccgctttttaaagcagattggtgcgcaggtggaaaccgcaggtactagtctgaagattgatgccacccatagtttaacggatcaaccgttggataattcactagcggagttcgccggtcccctgatgcttcggcagggtaaggtgatcctcacccccgatttcaatccccgcctaattgatgccctgaagattttgggagcaacggtagaaggccaaacggaccagataatcgttaaggccaccaacctgcggggaaccacgatttccttgcaagagactgatccacaggtgatgatcaccctgatgttgacggcaattgtggctagcgacattaccgtgatcaaaaatgctccccattcaccggcggtagtcgccctggcggacttgctgaaccgaatgggggcccgggttcacggggctggggagcgaattgtccggatccaaggggtcaccctcttgcacggaggagacgttttgattcctcgtaaccagcagacggcagcccgttggctaaccttagcggcgttaacggccggcgacctcttagtggatggggcctcgccgacctttatgacctcgttattaaaccacctggagcaagccgggaatacgattgtcaaacaagcaaccggggtccggatcatcgggacccactacccgttgccaaccgcgttgtcgatggatgacttcttggcgccctctttaattgatcagagcctcatgctcggcctggttactttcatgaacgggcggcggtccttagccggaaccaacttggatgacttaagcccagccctgaccgttttggaacggctgggggtgaccccccaagtggaagcggggtgcctgaagctctcggggcaaccaaccgattcgattaaggggccagtgaccccgttggctttaccggccgccttaatgtggctattagcgagcctgcgcggggcggctagcatcgaagttgaggtgaccgaccaagtagcccgggtaatcgctccttacttagccgccgtggctaagcagggaattcaagttgaaattagtgcccccctctaagggacttcgccgattctcggggtagtttgtggtataataacgaacgatagttttaaaaccggaaggagaaaaacatggctaaagacatcggaattgatctcggaacagccaatgttctaatttacgtccagggtaagggcgttgttttaaatgaaccatcagtggtggccgttgataccaacaacggtaagatcctggcggttggttcggaagcataccggatggtggggcggaccccaagtaacatccgggcggtgcggcccctcaaggatggggtgatctctgacttcgatattacccaggaaatgctttcctactttatcggtaagctaagcgtgaaggggttcatgtccaagcccaacatcatgatttgcgcaccaactaacatcaccgagattgaacgcaaggctattattcaagcggctgaacagtccggtggcggtaaggtctacctcgaatacgagcccaaggtggctgccatcggagcaggcctggatatctttaagccaagtggaaacatggtaattgacatgggtggtggaacgagcgatattgccatcctttccttaggtgacatcgtttcttcccagtcggttcggatggccggggataagatgaacaccgatattaccgaatacatcaaggctaagcacggcttggtgattggggaacactcggcagaacaaatcaagatcaagttagggacggccttgaaagtagccgaaccgaaaacgatggacgtacggggccgcgacgttgcgaccgggatgccacggcaaattcagattaacgagaacgaaattgaagaagccctgcatgataccctggaccaaatcgtgcacgctgccatcgccgttcttgaaacggtgccgccggaactggccagcgatattatcgaccgcggtgttatgttaaccggggggacggccctcttacacgggattgaccagctcttctccgagaagttgaaggtacccgtagtcgtttcccaagacccattagataacgttgccaagggggccggggaattgctggaacggatgcaagccaacccggctaacaacggcaaacggaagcgtaagcgcaagtaaatgaccaggctagtaaaagctctggtgatcgcctaccagcggtttttctcggctcgccgaccgtaccgggtgtgtcgctttgaaccaacttgttcggagtacatgcttcaagcgattgaccggtatcacagccgggggattttaatggggctggcccgcattttacggtgccagccttttgcacgcgggggatacgatccgcttcccaaccattttactctgaagagaaaccaaccaaagtaaaggtgaaacatgtcaaaaagagaaaaagcaattgaagtaagcgtccaagatagcgaacggaataaccaagccatacagcaggtctttattggcaagcggctgattggggaagtcgttcctgatgatggacggtttaaggcggtaatgttaaaggacgagacgtcatttcgggtgcgctcccaagaggagggcctagaaacgatcttgcaacaataccacctccaccaacactaaccattccctaatttcccgggaaataacgggatggtgacaaaggagaattgatgaatgcaacgtgcgaagacggacaacacggaggttgaatcccggattgactgggggatcattttctgtgtccttctattggccctaattgggctggcgtcgatttacgtggctgcttcccacgatagctctgggagtggcgttgtcaggcaggtggtgacccagttagcctggtacctcgtcgggaccgtaatggtcatcgtgatcatgcagtttgattcggaacagctgtggaagctggcgccgattgcttactgggcggggatcttcttgatgtttgcgattttgatcttttatagtcggtcgtactacgttaataccggggccaaaagctggtttgccgtgggcccctttacctttcagccttccgaaattatgaagccggcctacatcttgatgatggggcgggtaattaccacccataacagccagtacccggtccacaaggtcgattccgactggcggttaattggtaaaatgtttatgtggctcctgccaattttcatttcccttaagtttcaaaatgactttgggacctcgctagtgttctttgccattttcgtggggatgattctggtttccggggtgacctggcggatcctagtcccggccttttcaatcttggccgtggtcggggggagtgccctagcgatggtgacctcgacggccggccggacaatcttagaaaaggtcggttttcaatcctaccagttcagccgggtggatacttggctgcacccagaccaagatacgagtaaccagggttaccaactgtggcaaagtatcaaggccgtcggttccggtggtgtaactgggaccgggttcaataactcgaaggtctacgttccagttcgtgaatcggatatgatcttttcggtgatcggggaaaacttcggctttgtcggggggatcttattgattctactctacttactgttgatttacctgatgattcgggttacctttgacaccaaaaacgaattttacgcctacatttcaaccggggtcatcatgatgatcctcttccacgtctttgaaaacattgggatgaacatcgggctcttgccactgaccgggatcccgctgccgttcatctccgcggggggatcttcgttagtggggaacctgattgggatcgggatgattatgtcaatgcggtatcaccaccggtcttacatgttcagtaataaccaaaacttccactagggagtgatcagatgcgtgaattagcgaacccttggcaccaagagtaccaagggagggtggtggtcctgtcactaacgacagaagcccagcgaatcctcgggcccgttgagtactgggatttgccggaggtgggcgctaaagtggtggccaaccagccgttgatcgtggtgatggctaagtggcgctacaccgatctaaccttaccggtgaacggaacggtggtggcccgcaatccccgggccgttggttgggctgagcgcggggctaccgactggattttaagaattgaatgtaactaacgcacatggaggccgggaaaaaactccgttttccccggcctcttgctgtattcgcgagtattagacatcaaatgtggcaaataaccgcaggcccagagtctaagcaggacgaagaacggtgtggttcgcaccaaccgttcgcccgctcttacatgctacctgcaacggaggttatttccacccactttttaaagggggagcaagtcgatgaaagaaacagacctggcaccgaagttagaaatgatcaaagcgctccaccgccaagcaaaagaagggaagacctttaaggacctggcgccccgtttggcatcatttcaacggggcttacaaaggcaccggcggacgacagttagtctcccggccattacggaaacgggacaggcgattttagagcaactggtgagcaacctcaaaaatgaccagctaaccgaactcagcgacacccaactggagttgctcttgacgcagttagctaacgaggacccagccgttcgttttggtgaggcgaccttactctttaacggggccttagccaatgacctgttgaccaaggatcaacttcggcacgcaatgaacacgctaaaaaagtgggagatcttgtttgaccacatcgaggagccaatcaataagggtgctgtgcgccgggtgagcgcggtgactggccttgcctcgctgctatatgccgaccgggctggctatttcttcgtgaccaaagcagacctgagtgatttaattgaccgggtggcgctaggcatgttatgggagcatgataaccgggggtacgttaaccggttaggctggatccagctctttggtgagtacaccgtcttggtgggagaactatgccggcgcagggaactggtgcgcggcgaaaaggtcttcttaatggcgacctatttagtggcctaccgccaacttaaggccccactgatcatgggcgaagctgatgagggtgccgattttttaattgaaatgatgaatcaacaccccgtctaccgccgctacttcatggtctttttacgtgactggcaacgagacctgcaacaagaacggccccaaagcgaacagggctggcaccaggtctttaactaccgccggttaatgcaggccctgttgatgagcgctgacctgccggagattattgcccgccaaattacaaatcagtcaaatcaagacgagcaatgaaaacgaatttatgttatacttaagcttctaggaagcgtacgaaaattaaataatagataggagcacatcatgacagaaaagaaattacacgttgccctcctgttcggtggaaactcatcagaacacgatgtttccaagcggtccgcccacaatatttacgatggaatggacaaggacaagtacgatgtgtcaatcttcatgttcactaaggatggcatcttgctcgacaacgaagcctcccagcggatttttgatggcgaaccagaagatcaagtggttcaagaggcctaccaaaagatggacctcgatgccccattagccccgattgccgccttaagcacggttaaagaaatcgacttcttctacccggtgattcacggtaacctgggtgaagacgggaccgtccaaggcctgttccgtctcctcaagaagccgtacattggctcagggatcgcgtcttcggctatgtcctttgataaggacctcaccaagcggatcctgaaccaagccgggattcggaacacgaagtacctgttggtcaccccgcaaaacaaggatcaatactcctggtcgcggatcaaagaagagctaggggacctggtcttcgttaagccggccaagcaagggtcttccgttgggattcacaaggttgataccgaagaggaatacgagacggccatgaaggatgccttcacttacgactacaaggttctggttgaagctgggattaagaacccgcgggaaatcgaaatctcgattctggggaacgaaaatccgattgcctctaagttaggggggattcgggtaccagagggtgacgaattctacgactacgaaaacaagtttgtcgacgcttccggggtggtctttgacctgccggtaatcgttgacgacgacttagccaaggaaatcaccgacatggccctgaaggcctacgaagcattagggatgaaggggatggcccggatcgacttcttggtagacgaagacggcgtcccgtacctgggcgaaccaaacacgctgccaggcttcaccaatatctccttgtatccacaaatgtggaatatttcggggattagttactccgaattgattgatcgtctgattcaactcgggattgaagaatttgaacacgaaggccagctccggtacgacttcaaggccctgggggtcgaaaaggtcggcgaaaagcgttataactagttttgcccaagaagtggtcctgtactgcttctttttttgacttttcgaaaatctgatgataaattaagttaagcgagttactaagctaactttataaaagccatcaatcctgtgatttcaccttgcagttataaatgatttcaagtaaaatccaaagagtacatttggttttcagctcaattattggatgatatatataaataatgtgaacttatcacaaatcattattgataagattatgattttattcaataaaagatggtttttgcgccctatgatggtataaagtaagtcagtaacgtaatagccgaatttatgatatgataaaactaaataaaaaagttattatctagttagttcaatcagaaaagagttgagcaatcaaacaaccatacgatacagaaaagaagtgattataatgcgattaaagggagaagttttaaaacaggtacgccgtaagcggggattgtcccaaacggcgttggccgagggaatttgtacccaagcgaccatttccttaatggaaaagcaaaaccggattccaaagatgaatattttaacgtctttgtgtgcccgcttggacattccggtggaccggatcatcgaaaacgatgacgtttcaatgacggtcttctttgatcaaatcagtttgatgttagtcaaccatgactttgaaggagcccgcaagaagctgaaccgggtgaaggtcaagaagctacaaaatgattttgacaagcaacactactactacctcttggggatgctccaagtggcgagtgaccaagtggatgatgccatctttaactttgagctgattttgacgcaattctccaccaccagtgccaacatctacttggccatgaccacgatcgggatggccttggcatacgagaagcgcggcgacaccgaaaaggcgctccagtttgtcgggcgggcaatccacctgatcgatgacaagcagcttaacggtggtaagcggcaatggatcatcttgtaccacgagatttccggcctgtactatcgtttaggccagtaccggcgggcaatttcaatggctggacggggaattaagatctgccgggaagagcaaacactcttcttattgggtgatctttacatgacccgtggccaggcgcaagctaagttagaccagggcgacgtggcccaggaaagcttaaccgtcgccctttcaatctacaagatcatggaagacgacaccgcacaagagacgctctcacaagaattgagtcaattagttgaataaccaaaacaacgcccccgcttaccaatctggtaggcgggggcgttgttattagttactagtgctttttaaaggaagtcggttggttgtcgaggtcggtccggactacgaggacgtcacagatggccatccgggtaacgtattcggtaactgaaccgattaagatcctttctacggcgtttaaaccagtagccccaatcatgatcaggtcagcgtgcatcttttctggcacttcccgggagattagggtcttcggggcaccgtattcaatcgtgtaagacacgttggccaaaccttgcttcttggcgtagtcaacgtattgatctaaggtttgcttggcggtcttagttacttgttctaccattgacgagtcgaaactagaaacgttttggaaggcacgggtgtcaacgacgtgcaggagctgcaattcggtatctgcaccgttccgtagtgcaacggcaacggccttcttaaaggctagttcggcttccttggaaccatcgacgggcaccaggatgtgttggtattgttgagtcataatcggctacccccttgtttattatctatccctattctacacctttgaaagggtttacgcaaagtaagtctacaaaagctaggggattaaggtccggaccaccgttaaagtcattgctaattcaagcaaacaagcgacggcaattgcgctcaaggtaatcaccaccgagcaggtcagggccatgatttcaatgattacggccacgatgattaacgctaccccccaaaagaggtagaggccgggcattgggaccgccccctttaagtggaggttaaagagcgggcggtggcggtgggttagtaggtagcccccctcaattagcaggattaggttgaaacaggcggtgagcagttggatcagcatggtaattcctcccaataaaaaagccaggccggctagcctggttaaaaggtatgtatcaagctccgttcgtgccgttaattgtccgacagtgttgacctgtgtgtaagacaggtgggacatggcagtttagcattcggctaccaagagaaaaggcatgtcgtaaactaaacgaagcactcgtcccaaagtaataagactgtaaggcaaacctgctagatagacaaggcgtacacaacagagcttctataagtatattagcacatgcttggccaatcttcaaattagcgctggggaggttgctgaccgcgctgggccgccaaaagttggcggtattgcttggcaaaggcgcgttcgaaagtcccgttttgcttgggctggtagtactgatcgtttttaatccggtcggggaggtactgctgggcgacccagtcctcggggtagtcgtgcgggtagcggtaggtgaccccgcgccccagcttttgggccccttggtagtgggcatcctttaggtgatcaggcacggcgccgctattgccctggttgacgcgggcaagcgccgcgtcaatggcggcaatggccgaattggacttgggggagaggcagagttcaatgaccgcgttggctaacggaatccgcgcctcggggaagccgatccgctccgcagcttggaccgccgtgaccgcccgttcgacggccggcgggttggccagcccgatgtcttcgtaagcgatcaccactagccgccgggcgatgctaaccaggtctccggccgcaattaactgggcgaggtagtggagggcggcgtcggtatcggagccgcggatcgacttttgaaaggccgaaatgacgtcgtagtggccgtcgccgtccttgtcggcgaccagcgaccgcttttgcaccgattcttcgatcacggaaagggtgaggtaaatttgaccatcgctcgccggtgcggtggagcgggccgcgagctctaacccattcaaggcgctgcgcaaatcaccgttggtggcggtgattaactgggtgcgggcgtcgtcatcaaggacgaggggtaattttcccagtccccgttgcgggtcctttagcgctcggtcgatggccaggccaacctcagctgcggtcaggggttttacttcaaagatctgggcccggctccggatggccgggttaatggcaatgtaggggttttcggtcgttgccccgattaagacgatccggccgctctccaagtggggtaagaggaagtcttgcttagccttatcgaggcggtggatttcgtcgagcaataagataacggtaccggacatcttggcctcttcggccaccacttgcaggtcctttttgctatcggtggcggcgtttaaggtccgaaaggcgtacttagtcgaaccggcaatggcgctggcgatgctggtcttcccggtgcccggcggcccgtataggatcatcgaagagagcatccgggcctcaaccatccgccagatgatcttgccagggccaattaagtgttgctggccgaccacttcgtccaaggtgtggggccgcatgcgaaaggcaaggggttccatcattcctgccccccctttttaaagaggcgttgccaccaggataattggggcgccggctggtcttgagcggcggctggaaccgggtagcacttggccacgtcaattggtgactggtagacggcgtcatcagcggccatcactaaagccaagcggtccgggtcggtctcaaactgggggtcggtttttaaggtgaagttgccgccggcctgggcaattacttggacgtaggggtgggtcaattgatcggggaggttaccgttgatgaagacctgggtgaccacccccttttttagttcggtttcgacggcggttgtccaggagcgctccttaatctgggcgttgctgatggttaaacaaacccgttcccgaaaggtacctaagtagcgccgttgctcatcggggttaatcttgggcgtgccgtaaaccccgttttgcaggcgctgttctaagctgcttttttcttggttatccatgccagtcctccttttcgtgttcccattgtagcacaccacgaaaaaagacccgccaaagcgagcctgaattaagaatataggaggtatgattagcccttaacgatttggcagaattcaatcgtttcggcgttggggccttcaatgttgaagaacttgatcccgtgatcccagaagtcgaggtgttggacttctgtttccttcatcgtgaagccagcggccttggcggccttgtaagcggcgtcggcgtcggaggtgtttaaagacaggtggttgatcgccccggtcttcttaacggcgccgtcaccagtccagatttcaagggtcaagtgggcgtaggacatgaagaccacttggttgcccttatcgtcagtgtcaaagttcccggtcatcttgaaacccaacttttcccagaaggcgaccgtcttgtcgaggtcgtcggttgggatgccaacgtgttgaagatcgtcaaagtaacccgctaagctcttgttaaatgccatgataattcctcgctttcaaaatcaaacaacaaacaactagttcccaaggtccaaggcttggtgctttaacttcgggaagatcaacttatcggccaagcccgtgatcccaccttggaagaggagggcaaagatcgtccccaacccgaagttggccaggcccattgctgggatggcggccaaagccatgatcgttggcggaatgtatgaagcccacatagccaaggtggcgttgcccttgaagtagcggaagcgcaggatctggaacaggtcatcggccgggtgcaagaccaggttgacccgctggtagatcgagatcgccaccccgatgaaggtcacccctaagaagttgatcaagacgtagaggatgatcatcggcagggagtgggcgtcgggcatgatccggttgaagatgttggagaaccactggatgaaaattgagaacggcagcatgaacaagaagttcccgaaaatccggtgccagtcccacttgtgcattaagatggcgtttagaacggaagtcagcatccccaggatcatgaaggcccaaaagagcgccatcgaatttcctttacctaagacggcgtaaccgaggttattttcggcggcggtccagtaggcggatcctaaaaattgcgggtggatgtgggaactggtgaccaaggttaagacgttccccatcgagttaacgacgattgaaagggcgaagtaagccagggaggcggacattgaaatggtccggccttgtaccggcttgctagtcgcactagcagcatttgattccataatcttattctccttctcgttggtgaaatcattcacttacggttactaaatttacgactggttcggttctatgtcaagcggttgacagaaaaaagttgccgaccagggaaagttagttaaatcaacgcaacgccccgctatataattagcggcgattggccatgcaatcgccttcacaaatggtgtgaaaaagagcacaaaaaaggcccgttctacaaggaaaacgggcgtaaacttagaatgtgaagtggcggtagttgccgacctcgacgtcgacgcgcgccaccacgataaaggaggacggatcggcggtgagggcgagttggcggatgtggcggaactgcccgcgtggggtcacgatttgaacgacggtggttggttggttggtgtaaaccccggtccccttaatcatcgttgccccgtgggtaaagtctttgagctggtcggcgatggcttgcgggttcttcgtgtagatcgaaacgatgacgtctcgctgcgaggagaagaagtggtccatcgtgtagttggtaatcaacatcccaatcagggagtagacgatccggctggggccaaagaccagggcggtgatcaagaggatgaccccgttgatgatgttggcaatcgaaccaacgttacggtggaacttcttttgcaagtaagtggtgacgatgtcaatccccccggtggtaaagccgcggttgaagcacaggccgactccagccccaatcaagaccccaccgacaatcgtgttggttaggggatcggtaaccagttggtaggaggggatgatctgcaagaagatgatgttaaacaggaccgcgagccccgaaaaggtgatgtagtgggtcccaaacacccgccaggcaaagatgaagagcgggatgttaaagatcgccaccagaagcgagagggagacgttgatccccgccaactttaagagggcttggaccaactgggaagccccggttaagccactggaataggaattggcgtgaaccaagaacatgttcaccccgacggccgacaggagcccgaaaaccagggcgattgagacacgaataaggttgcgacggacggtcatgaaaatcctccttaggtttagttattgcttctattatcacgtctgagattgactttggctagggggaatcgggaaaaggtattcgataaagatgatacttttaggatcatcattggaaagagccatagtgaacgatatgtttctagtattcgaagtgatgaaggtgaaattcttttccctcgtgggactcgattcaaagttgtaaaatactaccaagatgagaatggtaaaaacataatcgatgtggaagaagttgaatgatgaagagatgcgacgattgagagctttggatcgaccaactactgaacagttacgagagtggttgaaggatgtcccaaagtcaaaattaactcctgaagaactaaaaagacgggaagcttataaaaaagccgcctacaaaaggtttagggagatcgagaaacgtcgccaagagaggtcaaacaatgggaagtaacgatttcttcacggtagcctataaaattctaagttacctcaagtactgttatgaacatggtgaacaacctgatccaggtgtgattaatgagcgaacgctgctgatttccaaagcccagtacgttgagacattgcgaatgttgagcgatcacaactacgttgagcgatcacaactacattgaaggagttaccttcacccacacgaaggagggagtcttgtattcgttccaggacgcaagaatcactatcgaaggcttggaatacctggccgagaactcaatgatgcagaaagcttttagaatctttaagtcgtttaaagaatggctataaacggttaccagatggtagccgtttttttatgtccgtttccgtgcagttgtggacgttaaataaaacccgagacaggctcccaagccgttaaatgcgagtaggaggtttcaacatgccacaagatgttaacgagcaaccaaagaacgttgcggaaaatatcgatgtcgaatcacaggaacaagcaccgaagaaggacgctcctaatgttttaccaaaacaaaaagccggccccgtaacggagtcggcttttttaacaagtaaccgagattacttgttgtagaattcaacgatcagggcttcgtcgatgtcggcgttcatgtcttcacgttgcggaagacgggtcagcttaccttcgagcttgtcagcgtcgaattcaacgtaagccgggcgagcaacaacggcttcaacagcacccttgataacgtccaggttcttggacttttcacgaacggcgatgacttgaccaaccttaacttcgtaggaaggaatgtcaacgcgcttgccgtcaacagtgatgtgaccgtggttaaccagttggcgtgcttgacgacgcgtggtagctaaaccaagacggtaaaccatgttgtccagacgacgttcaagcagaaccatgaagttggtaccgtgagtaccttccttgatcttgccggcgcgaacaaacaggttagagaattgccgttcggtcatcccgtacatgaaacgaagcttttgcttttcgcgaagttgggtcccgtattcggaaagcttaccgcgacggtcgttcccgtggtcaccaggagcgtacggacgacgagcaagttccttaccagtaccagaaagtgaaacgcccaggcgccgggaaagacgccagcttgggccagtgtaacgtgacataattgaattcctccaaataatttgtattggagtaaaataatccgatggtgaagctgacattcgtgcaggccaattggatcgttcaccctcgcagctgggttactagaaacaccaacttggcattggtctgttgacgagcttgcctcttcattgctgcattattttacacgtccactatcatacaacgcttaaatcgaccgggtcaagcaattctttgaaggaaaacggttagaaatccgggagttcaattgcttgtctggggataagtagggtaagattatgttataatcaaaagttaattaagacttaaaaagtataggtgggattcggatgttacaagtgttaattgggatcattgcgattgccgtgatcgttgtcatcattttttacgtgtgccaacgacgggcgatgcgggtcattacagacttacgggcccggctggtggccctggaagaagcccggttagcacgccggttggatgacgccagcctcgctgacttaatgggggaatcgttgaaggtgttcaccgccttgcaagatgactacttaaaaaaggtggccccggccgttgacgacgctaacgaacaattagaagaggttagcaagaacctaaacgggatcaacgtcttcaccgtgacgggacagttgaaccaggttcgggagttagtcgaagaggccgaacggcagcaaaagcgggtcgttgaccggctccaaaaggcggaccaaaaagaagaagagcaaaaaaaggcgaccgccacgatgggcgagcaactaggcgacttccaaaagaaactggatgacaccgcctaccagtacggggatgccattcggcccttgcgttcccagttagccgatctgcaagagcagtttacccgctttaacgagatcgccgccaagggtgatcacgaagcggcggccgaaatcttaaccgacttaaaggaaaaagaggcccactttaccaagctggctgaggagattccagaactttataagccactatttaccaccttcccggaccaaattagcgagctgcgtgagggctaccgcaagctagtggctaaccactaccgcttcccggtcaacaatttggatgaccaaattgaaggcttagaggcgcaacggcagaccgccctggatcacattgccgccctttcgctagccccggtccgggtggccaacaagagtttggaagaaaaaatcgatcacctatacgatgtgatgcagaacgaaatggatgcccggccccaagttgaaaaattggtcggggtggttggcgatcacctagatcacgctcgccagcaaaaccgggagttgatggccgaattagaccgactgtccgaaagctacacccttaatcacgacgaggttgcccacacccgcgagctagaagaacaacttaagcagatccaaaaggaatacgaaaaggatcaagtagccgttaacgcccaagcggccgtcgccagtcaagtcctagaacgcttcatggaagacgaaaaggtcttaacggcgatcgaaacccagcaaaaggaaatcaatgatggggtggcctacctcagcgaagacgagcagcgggcccgcaaggccttgcaacgcttcgttaccacggtccgggccaccaagcgccacgttgagaccctcaacttgccggggctgccgcaagattacctggactttttcttcctggtctccgatgaaattagccacttggccaaggacatgaaccagcaacggatcgacatggaggccatcactaaggaactcttaaaggttcaaggcgacgttagcgaattaatcgaccgaaccaacaaggtgcgtgactcggcggaactgaccgcccgcttaatgcaatacgggctccgctttgtcgatgacaaccaagagattgacgccgccattaccgaggcgcaaaaactctacgaccgctacgaatacgagcagagtttggaaacgatcggggcggccctcgagaaggcagaaccgggttccttcaagcgtttggaagacaactactacgatgaattagatgaagaagagtcatagataacaaaaggggtgcgacgctggtcgcgccccttttgctatccaagcccctagtgatctgttataattgatcggtatttggagtcgaacaggccattggtgacgcacgcaatcactttatccacactaatggcatatcttgcgttggtatccagcgcgtgtgaaaagagggaacacacaatgatttattttgataatagtgccaccacacaggcacgcccagaggtccttgcgacctacaaacaggtttccgagaagatttgggggaatcccagttctttacacaagctcggcgaaacggcttggaacctgctagaacaaacccggacccagatcgccaatacctttggcgttcaacccggtgaaatcctgtttacttccggcggctcggagggggacaactgggtcattaagggaacggcgcttgcaaagcaaaagtttggcaagcacatcatcacctcatcggtggaacacgccgccgttcgtaacgcgatgcaaagccttgaaaagttgggctttgaagtcacctacctgccggttgacaaggagggacgggtgaaccccgcagacgtgaaggccgtcctgcgtaaggatacgatcttagtttcgatcatggccgtcaacaatgaggtcggcaccatccaaccaattaaagaaatcggtgcaatcttaaaggactacccgaccgtccacttcatggtcgacgccgttcaggccattggtaagggtttagacgacctggtcttttccgaacgggtcgactttgccaccttctctggtcacaagttccacgccccccgcggaactggctttatttataagcgggccggccgtaagttagccccactgatcgatggcggtgggcaagaacgcgggttgcgcgggggaaccgaaaacaccccgggtaacgccgccatggcccgggcaattcgtttaatgaaggaacaagaaaccacggatgtcgctaacgaacaggcggtccgcaaggccatttacgatcacatcagccagtttgaccacgtggaagtcttctccggcttaggcgccggctttgcccctcacgtgttgacctttgccatcgtcggggtgcggggcgaaacgatcgtccacgcctttgaagaacatgacatttacatttcaaccaccagcgcatgctcatcaaagaagcactcggaggcctctactttggccgctatgaaggtgccggataacgttgccacctcggccgtgcgggttagtttgggggaccaaaacaccctcgccgatgccgaagaatttaaccgggtttttgatcagctttacgccgggtttaaaaagattattgattaaggagaaccgttcatgaagtacgatgaaattatggtccgctacggtgaattgtccaccaagggccacaacaagaagtcattcattgaccgcttgggttccaacgttagaaaggcgctccaccaatacgaccaggtcaagattcacccgaaccaggaccggttgcatgtggagttaaatgggaccgacgccgaaccagtcatggagcggctcaagcaggtctttgggatccaaaacttttccccgtccttgcgggtggaaaaggactttgattccgtggtcgaagcggccgtagcgatatttaaggaacaggtccaggggccgaccaccttcaaggtggaaaccaagcgggccgaccacaaattcccgatggggacctttgaaatgaataagcaactggggggcgcccttttgaaggcattcccaaccgacttatccgtggacgttcaccacccggacatcacgctgcgggtcgaaatccgcttaaacgggatttacctgaccagcgccaaaattttaggggccggtggtctgccggtcggcaccgccgggaagggaatgatgatgctgtcgggggggatcgactccccggtggccgcctacctagcgctgaagcggggcgtttccttagaaatggtccacttctactccccgccgtacacctccgaacaagccctggccaaggccaaggaattgaccgggaagttagctaagtactccggctcgatcaagttcattcaggtgccgtttaccgagatccaagaaacggtcaaggaaaaggtaccggagggctacttgatgaccgtgcaacgccgcttgatgttgcgcttggcctgtgccctagcccaaaagcgggcgggcttagccgtctttaatggtgagtccctggggcaagtggcttcccagacgatggaatcaatgttggcgatcgaagacgttaccacgatgccagtgctgcgtccggtgctgtcctacgacaaaaacgagatcatcaagatcgccgaagacatcgacacctacgacctgtcgatcttgccttacgaagactgctgcaccgtcttcacgccgccttcgccaaagaccaagccaaacctgaagcgggcccgctcatacgaggcgcgcctagacgtggaaggcttgatgcaacgggccttggacggaattgagatcaccgaaattcacgccggcgacgaattcttgaaccaaaaccaagacgtcttcgcggaattactataattgttagtcaaggggctagggaaccagttacggtttcctggcttctttttttgttgcttgctacctttggggacaggacaaatctacaaatttacgcaaactggaagtgcgatccaaccttctcgacgggccgtatggctaagctagggcaaatggttgtcgccctcggcgccgttcttcgcccgtacttagatactaggcccgtggttgggtcgcactcctttttattgcacaaatccaaatatttgtcctgtctcactttcggctttgcgctactcagttttcccaattgaccattgaaactaacctaatttcgactttcttttacaccaaggtggggtataatcgctaatgtaatcggttacacagaacctaaaggaggttgacgatggttatttcgtggtggggagcgctgattggcttggcgctcgcaatctacttaattttaaagaagctcaatccggtttattccctgatgcttggggcgattattggggccttgctcggtggggccagcctgactggtaccattgacatcctggtcaagggggagcaaagcgtcatggggacggtgctacgggtgctagccgccggaatgctagccggggtaatgatggaatccggggctgccgaaaccttggcccgcacgatcgtggataagctgggcgatcgaatggcgattttgtcactggccctagcgacgatggtcattaccgccgtgggggtcttcattccggtggccgttttgatcgtggcgccaattgccctggaagtggggcgacggatgcatatttccaagctagccctcttggtcgccttatccggtggcggtaaggccgggaacatcatttcgcctaacgccaacacgattgcggcggccaagggctttgggctcgagttaagccaggtcatgatcgccgactttatcccggcggtggtggccctgattgtgacggtgatcgtggcccgcttgttggttaaaaagggcgacgccgttatggaagccgatttaggcgacatggtggatagtgacaccggcaacttacccacccttggtcaggccgtggtgaccccgattttagcaattgtcttactcttattaaatcccatcggccaagttgcccatttgacgctgttgactaaggtgaacttagacgcgacctacgtactgccgtttgccgcgattgtcggcgccctggtgatgaaaaagggccgggagttgcgcgattacgcccgggtcgggatgacgcggatgaccgacgtggtcttgatcttgatcggggccggggcgatcggggcgacgattacctcgtcgaacctgccacaactcttaatcaagggagtggaggctagccacatgcccggggtcttgttggcaccgatctccgggatcttaatggcggccgccaccgcctcgacttcgaccggggtcatcctagcgaccggctcctttgctaaggcgatcttaggctttggggtcgcgccactggccgccgccgccatggtccacaccggggcgatcgtgatcgaccagctgccacaggggaactacttccacgtaacggccaacgccatgcacatggacctgagtcaacggtcgcaagggatcctatatgaagccatggttgggggctcggcaatgctgaccgccacgattctctacggtttcttacacctgatttaagggggaagtaaaatgaagtttgtgattgcgcctgattcgtttaagggcagtttaacggctaaggaagcggccaccgccatggcgaccggcattaaacgggtttatcccgacgccgagctaaccttggtgcccatggccgatgggggtgagggaacggtgcagtctttagtcgatgctaccaacggccagctcttgatcaagaccgttcacggcccgcttaaccaaccggttcaagcccactatggcttgctgggtaattccaacacggcggtgattgagatggccgaggccagcgggattggctacgtgaccgaagaaaccaagaacccgctgatcaccaccacttacgggaccggggagctgattttggatgccgttagccacggggtcgatcaaatcatcatcgggattggcggcagtgccaccaacgatgggggtgccgggatggcccaggccttgggagtgaaacttctcaatgatgccggcgagcaggtgggcctcggcggtggcgccctgggggaagtcgcccacgttgacgtcagtggggtcgaccgccgcgtcaaggaagtgaaggtgttaatcgcctctgacgtcactaaccccttgaccgggccggaaggggcgtcggccgtttttggcccgcaaaagggggcgaccccggagatggtcaagcttttggatgacaacctgcaccactacgcagcggtgattaaagccgacctgggcagggacctggaggaaaagccgggagccggtgcggctggcggattggggaccgggctcttggcctttaccaacgccaccatgcaaaaaggaattgaactggtggttgagtacagccagttagaggagcaggcggccggcgccgattacgttttgaccggcgaggggagcatcgattttcagaccaagtttggtaagaccccgtacggcgtggctaagacaaccaagcgggtggccccccaagcgccggtaattgggatcgccggtcacctcggtaagggcgtggccgaactagccgacgagggcgtgatcgacgccgtttttgccagcccgtctggagccaagtccttagaacaagcgattgccgacgccgcccaggacgtggcgctgaccgcggagaacgttgcccggctgattaaggttagtcattaataaggaagtgcgatccaacctactcgacaggccgtgggctaaggataggacgggggttgatgcggtacgcatcgttctccggccagacttagccactaggcctgtggttgggagcacgttatcttgggaagtgtgacccaaccatttggcaggccggatgtaagatcggtcgaaggtgaatacgttagctaatagagcccctgaatcattatggttcaggggttttgtcgttgtatcgattgaccattgagattaaatcattaaggaactccttgaacggtatccatttcccaatgaccgaaagtggtgcgagtttccacctcttttggtcgttgggaaatgttcttacctggctgttcacgctttggagttcgaccatgtttggccttagtacgccgagttttctctagaaggtcaataatcttcgttcttaggagtcccttatcaatccagttgtaaatggacctttccgatgcgggaagctttacgtcgtcattaacaagcgattctgcaatcttgagcgcagcgtaaggtgagcatttttgcgaatctaatgattcaaacttgtcatgatccttaaagtcaaattcgcccaacataagatcatcaagcaaattaatgatttcaggggatgattgataaattggtgttctgccacagttagacctgcttttttcaccattaattcaggagttgacgatagggaggatcatcatgcaagaaaaactgacgaagctactaaaggaccgccggatgcttgggggactcggggcggcgattttaatcattgtgattgccgtcttgattcacggccggacggtcaacgtgttgcaaaacaagtactttgaaccgaagtacgaagggatcgacacgcaaggctatatcacatacaaatcgcgttaccaactctacaagtcaattggggatatcttggcaaaaaaggctaagttgaccaagatggaaaccgaagcgatcgttggggatgggtcgaacactagctatattttggatggtgacaaagttaatgactacctagaagagcattactttgatctttcaaacaccgacaaggaacacctctccctgttcaagcgctaggcaagcgagattacaatttctgtcagtgttaacggaaaggaaacctcgacatcagggctgaagaacggtgataaggttacgtttgaaattaaggttgctaaggacgccgaaaagaagaacccgatccgggcaagcaagaagacctacaaggtttccggtttgaaggaacggaaaacgatcagcctttcctctgtgtacagtaacttaaagatgaaagctgaaggtgttaaatctaagcataagagtgagaacagcattcaatttagctacaccggtaagccgaagttagacttgggtgacttggatgattcctacgataacaaggggtacgtaaacggtaataaagtcactgtcaaggcaagcatcctcttaaaaaagttacgtgaaaataatccagactacaagtttaccggctcggggaaccacacgtacacggtcagcggattagtggacaagagtgctgactacagtaagctagtcaattacgttgatagcgagaagaaaaagaagaagattcccaaatcgtttattcaacgagcattaccaaattgggtgaccttcaaaaggtttacgtagggagggacacctatagtgatggcaataagtatgaagccatcttggtttaaactaattctgacagtgactcagacgaaaaagctctgtactgtaaattagatggccttaccttcaaaaatgggaagttacagggcgctgataactaccgcattacgagcgatggagatgttgatgacatgctccagcttaagtaacctgttttcaattcagtaagggtgtacccctttacccagtccaagcgctcaccaatttcggtgggcgtttttctggtgaaaggcaagcccaatctgctatacttaacccatagttgctagattaaagaatcattaaaatgaggccacaatcgtggaagtaacgatcaatggtgaacaccgtcaattagttggaaacccgccggccgtcggtgaagacgttccgcactttaaggtctttgataaggataaccaaaagatcaagacccgggaactgtttggcaagcccactttgatttcggtggtgcctaacatcaacacctcggtctgctcaattcaaaccaagaagttcaaccaactgatggaccaatacccaggcgccaacttcttaacggtgtcgacgaacacgattgaagaccagcaaaactggtgcgccgctgaaggggttaagaacatgaagatggtggccgattcggaacaatcctttggttatgccctcaaggttttgattccggacgaagggatcctggcccgttcaatttgggtgctggatgccgatggcaagattgtctacgaacaagtggtgccagaagtcgttgacgaaccagattacgacgccgctttagccgccctgaaaaagttgctctaggacttgacggctggcgaaaagttatctatgatttaagtcattcaatgcgatgaacgagagagtaatgaatagagggaccgcctaagcgaggatccggtggtggaaaggatcccggcactctgatcatgaaggtagctcgtgagcaggagtcctgaattaagtaggggttcccggttcatttaccgttatcaaatggcaaagagggagtggcagtggccacttcaaattaggtggtaccgcgagaagactcgtcctatgttagggcgggcctttttttgtacccgttaccgaagggagaaatttaaatgaccgaaaaagaaatggcaaccaaattcgacccccaagcggtcgaagaagggcgctaccaatggtggatcgaccaaggttttttcaagccgtctggggataaaaaggcgcacccttactccatcgtgatcccgccgccaaacgtgaccgggaagctgcacctgggccacgcttgggacacgaccttacaagatatgatcattcgccaaaagcggatgcagggctacgacgtcttgtggctgccggggatggaccacgccgggattgccacccaggccaaggtggaagcccggttggccaagcaaggggtttcccgctacgacctgggtcgcgaaaagtttgttaagcaggtttgggactggaaggacgaatacgccgccatcattcaccagcaatgggccaagatggggatctccgttgattacgaccgggaacgctttaccttagacgaagggttaaacaaggccgtgcgcaaggtcttcgttgacctttacaacaagggtttgatttaccgggccacttacatcatcaactgggacccgaaggcgcggaccgccttatccgacatcgaagtcgaacacaaggacgataagggcgccttttaccacgtcaagtacccgttcaccgacgggacgaccttcaacggcaaggactacatcgaaatcgccaccacccggccagaaacgatgtttggtgacgaagccgtcgccgtgaatccaagcgacgaacgctacaaggaactggtcggcaagcacgtaatggtgccgctggttaaccgcgaaatcgaaatcattgccgacgattacgtgacgccggactttgggactgggatggtgaagatcacgccggcccacgacccgaacgacttccaagttggtaagcgccataacctgccggaattaaacacgatgaacgaggatgcctcgatgaacgaaaacgccggcaagtacgtcggcatggaccggtttgacgcccggaaagcgatcgtcaaggacctccaagaccatggttacatgctcaagatcgacccaatcgtgcactccgttggtcactccgaacggaccggggtgcaagtcgaatcccgcctgtcgacccagtggttcgtgaagatgaagccgctggcagaacgggccttggctaaccaaaagaccgatgaccgagtcaacttcattccggaacggtttgaacacaccttcaaccagtggatggaaaacgttcacgactgggtgatctcccgtcaactctggtgggggcaccaaatcccggcctggtaccacaaggaaaccggcgagatgtacgtcggaatggaagccccagccgatgcggaaaactgggttcaagacaaggacgtcttagatacctggttctccagcgccctgtggccattttcgacgatgggctggccaaacaccgatgccgaagacttcaagcgctacttcccaaccaccacgctggtaacgggctacgacatcattttcttctgggtctcccggatgattttccaatccctggagttcaccggcaaggcgccgtttagaaacgtcctcttgcatggtttgatccgtgacgaacaagggcgtaagatgtctaagtccctgggtaacgggatcgacccgatggacgtggtagaaaagtacggggttgacgccctgcgctggttcttggtaactggttcaacgccgggccaagacatccgcttctcttacaagaagatggacgcctcttggaacttcatcaacaagatctggaacgccagccggtacgtgatcatgaacctcggtgacatgccggcgccacaactgccggaccaaagcaagtgggacctggccgaccgctggatcctgagccgcttgaacacgaccgtcaaggacgttaccgccaagttcgagaagtttgaattcggggaagctggccgtgacctatacaacttcatttggaacgacttctgtgactggtacatcgaaatgaccaaggagaagttgaccaacgggactgacgaagaaaaggacgccaccaagaacatcttgggttacgtcttagaccagaccctgaagctgatccacccaatcatgccgttcgtaactgaaaagctgtggcaggcaatgccgcacgatggtcaatcgatcatggtagcggactacccggttgaacacgtcgaactggccaaccaaaaggccgaaggggaaatggaagacctgatcgaactgatcaaggccgttcgtaacatccggaaccaagcgggcgccccaatgtcgtcaccggttaaaatgatgattaaggtggatgatcaggcccacgccgccgtcttcaacgaaaaccgggattaccttgaccgcttctgccacccgtcagacctaacgattgccaccgaagtcgacgtgccgaagctggcgatgagtgggatcttggccggcgccacggtttacatcccgatggccgaactggtggacctggacgaagaacgggcccggatggaaaaggaaattaccaagctagaaaaagaggttgctcgttcaaccaagaagctggggaacgaaaagttcgtcaacagcgcccctgaacaggtggtggccaaggaacgggccaaggccgaagagtggcaacaaaagttagcgagcgccaaggaacgcttggcgagcctgcaagaaggataaagtgagtgtgacccaaccttctcagcggaccacgttatccgtcatagttaagaatcagatgaggggttgggaaagttttcccagcccctttaatgaaaagggaaaataatggaagagattacaacttacgaccaggccctagccttcattcacggccggacccggttcaaaaaaattccgaccctcaaaagaatgcgcctctttttggagcggcttggcaacccccaagagggcctgaacatgatccacatcaccgggaccaacggtaaggggtcgacggtggcgatgactagggacatcttgggcgccagtggcctgcgcgtggggaccttcacgtcgcccttcattacccgctacaacgaacggatggccatcgatgggcagccaattagtgacgaagatttgacccggatcgctaaccgggtcgccaaggtggcgacggtgttagaccaggagctaacggagggcgggccgaccgagtttgaaatcggtacggcgattatgttttgctatatgaatgagcaacgccccgacctggttattttagaggtggggattgggggtaagtgggattcaaccaacgtgatcgaagcccccttggtaacggcgattacgaccgtcggttacgaccacatgcgctacctgggcgacacctatgaacagatcgctagccacaaggcgggaatcatcaaggagggggcgccgctagtcattggtcacctcccgaccagtgcccgggaagtggtggcccaagtggccaaagcttaccacgctaaattgtatgagctcgggaccgactttgacgcaccaaacgtcactccccacgccctgtacccaaccgtttcatactcggggctagggctacaccgggcccagtttaagttgggcctggccggtgactaccaggtggcaaacgccgccgtggcgatcacggttagccaactggccttagccgccctggggctaccggtgctagccaaggacgtcaggcggggcttagaagaaagtgcctggccggcccggatggaagtagttaacgatgaaccactgatgattttagacggggcccataacctgccgggggtgcaggcgctcgtgcaaacgatcaaggacgacttttttgatcggcaggtctacttggaagtggcgatcctggccgataagcagtatgaactgatgctgggcgaattagcgagcctggccaacgttcacttgctggtgactcactttgccgggccggcagcgagccgccccagtgcggacctaggattggccgttaaggaactggcgacccgctacccggtggaatacgtccctaactggcagctggggatcgcccggctggcccaagaggcccagggtgacgacgtaatcatcatcaccggctccttgtactttgtttccgaagttcgccaatttttattagactaatttcgttaaaataaatctcctcaccgtacttagatggtgaggaggttttaatatgctaaaacaacaattacaatttccgctttaccaccagacgattcacgaggccttgccggatcccgacttggcccagcattttttggaccgcttcccaactccccgggcgctacataacatcacggccgaagaagaagaggagttgaccgaatacgaccaacaagcctttaaaccactgctggcggcggtcaacctggggacgatggcggtacgctcaccccacgatctctacgggcaggcggcctcgtcgacctcggtggggacggcgctgatcgacgagtttgccggcgaagaacaggaaatggtggtggcaatgtgtaccgatgtccacaataaaatcattgccaccaagcggctcttcattggcgggaccagtgagtgttccacttatcctaatcaggtgttccgcttcgccattaaaaccggggcgcacggggtgatcttggcccacaaccacccatccggttctccggccccttcaacggccgatatgatctttattaaacggatggaagaagcaggtaaattaattggcatcgccctgattgacgccctcgtggtgggcagaagggattactatagttggcgcgaggcccgtcaagaagaggaagaaaccgattggtgaaatcttaaataatcgttaacgctctagggcggatctgtcaattcccgggccattatagtatagtagggtctgttaatctaacgtttggctatggtataatatcggcgatatggattaccacaaaagaacgtattaaacgtacaaacgaagggaagaaacagattgccattaggatttggaactaaaaatattggtatcgacctcggaactgccaatacaattgtttacattgatggaaagggcattgtcttgcgggaaccgtccgtggttgcacgtaagaagggtaccggcgaagtaatttccgttgggtccgaagctcgggacatgattgggcggaccccggcaagtatcgttgccatccggccaatgaaagatggggtcattgccgattatgacaccaccgttgccatgatgaagtactacatggacaaggcgctgggcaacaacggcggcaagccatacgtaatggtttgtgtcccaagtgggatcaccgaagttgaaaagcgggccgtggttgacgcaacccgggttgccggggcgcgtgatgcttacgttatcgaagaaccatacgctgctgctattggggctggcctgccagtcatggatccgaccggttcaatggtggttgatattggtggtgggacgacggacgtggcgacgatttccttagggggcatcgtatccagtcgttcaattcggatggctggtgacaagatgaacgacgccattgcccaatttgtccgccaaaacaagagcctcttgattggggaacggacggccgaaaagttgaagtgggacattggttctgcctccttggacgctgccaaggaaatggggacaaccgaagtgcgtggtcgggacctgattactgggttaccgaagacgatggaggtttccgccttggacgtttccgaagcccttcaagatgtggtcaacgaaattatcgccgctatcaaggggacgttggaagaaacgtcacctgaaattgccgctgacgttatcgaccacgggattgtgctgactggtgggggcgctttattgaagcacttgccagaagtgattgcggaagcgaccaaggtgccggtctttattgccaacgatccactggattgtgtggccatcgggactggggaatccttgaagagcatcgacgccatgcgcaaaaagaagtaacggatttcattgataaatcaccaacgagaaatcgtgaaacgggcggggctggttgcaaaacaatgtttttgcccagccccgttcatcgttctcgggggctaaagaggagctttcttccatgcaaaagtttttttcaaaccgtcgcctagttattttagtggtgattctcgtggtctgctttagcttgatggccggttccgtggccttacggaaccggcggagcacgccgcctctgatccagcagtttggtgatgacattgtcgggattgccggtagcgtggtaacctacccggctaacatcatccagggggggctgtccaacgttaacgagttaatgaatacctactcggaaaacaaggagctcaagcaacaggttacggaattagcccaagttaaggttagggaccaaaccctggccaaggaaaataagcagttaaaggcggaactaaaggtaaagtcctctttgactgattactcaaccattgccgcctccgttttaagccgggacccgtcgtcttggcaggcccagttagtgatcaataagggttcctcggccggaattaaaaagaacatgccggtcttatcgggtgggggcttggtcggccgggtttctcaagttaacaagaccaacagtattgttgagttgcttagtgatactagtgaatcatcgaaccgctttgccattacgattcaaggtactaacggtaagacggttaacgggatcatcactggctacaactcgtcaaccaaccagttgatcatggggcaggtaacttccaaggccaagatcaagaaggggacctcggtgacgacctctggattagggggaatcacgccaaagggactctacgtcggtaaggtggctaagatcggaacggatgattacgggctggcccaaaaggtttacatcaccccggccacgaacttcaacgagatcaacattgtgaccgtcgccaagcttgatgattaagtagggagggttaccatgtaccgattatcacgtctgaggttcctgttcccgctgggcctatttatttgttttttcctggatggctcactgagcaagatctttgccaaccagttcttcagctacccctacttaatggttagccaactggttgttttgtggctgatcttcggggccttttttgaagaggatatccaaattcccctgactggctttgccgttgcagcggggatctgtgcggacctttactactcggggattctagggttgtttatgttcttatacccggccatcgtgatgtttgcccgggccctcaaccgctactacaccccgtcgtttctatcccatattttaattttctttgtttcaatcgccctgctggagttactcaactattgggcatactacttggtgggggtaacccgggtgggccttgccggtttcttgttggatacccttggcccaaccttggccctgaacctggtctacttcatcttgttgtattggccggttcaccgcctctatcaacgggcgcttggggagcaacattagaatcgatgagaaaaatttaatttttcggccagaactgttgacaagaaaatcaaatctagttaagatacttacaacattaacaacgacattgagcagattagtagaacgatgcgtgctatcagcgagtaaccggtggtgggaaggttacagtactcccgttcgaatcacaactgtgagttggccactgaccaaaaggtggtccggggaagcccgttagcgcgcaaagtttacaattcgtgaacttactgaggtcgtcttccgtgagggggcgacaagatgaggtggaaccgcggcaacgccctcttagccaagtggctaggagggcgttttgtcttttgtaaacttgctgaggttaccagtgtgagctggtaatgaactggggtggaaccacgttaaggcgtccccttgaatcaccacgattcaaggggcgttttttattaatttgcttaatgggggaagacaaaggaggatcaaccatgtcgtttaaatatatcatggaaattttaccatcgttatttcagggtgcaggattaaccctgcaactcttcttttggaccctaattggctccttgccattggggatcatcgtcagtctgggcttaacttctaagatcaagccgctcaagtgggtcttggaaatgtacgtctggctgatgcgggggaccccgttgctactgcaattaatcttcgtcttttacggcctgccaatcatcggaatcgttttccaacgttacgatgccgccttggtggcctttatcttaaactacgccgcttacttcgccgaaatcttccggggtgggttgcaatcaattagccagggccaatacgaaggagcccgggtgttgcgcctgtcatactggcaaacggtcaggaagatcgtgattccacaagtggtcaagattgtaatcccgtcaatcggaaacgaagtcatcaacttgatcaaggattcctccttggtatacgtaatcgggttaggcgacttgctgcgggccgggaacgttgccacctcacgtgacgttaccttagtgccactcctcttggttgggttaatctacctgctgatggtcggggtctgcacggtcatcctgcgctgggttgaaaagcggtactcatactacaagtaatcggggggattgagatgttagaaattaaagacctaaaaaagagttttgacgggcgtcggattttaaacggggttgacctgacggtggaagacggtgaaatcctcagtatcgttggtccatccggggccgggaagacgaccctgttgcgttgcatcaccgggttagagagtgccgacagtgggacctttttaattgacgggcaaccgttcgacccccagggaaccgaggaaagcgacgccgtgatcggggtggttttccaagacttcaacctcttcccccacttatcggtgctggaaaacatcaccttggcgccaacaatggttctaaagcaaagtaaagacgaggccaataagaaggcggccgaattgttagaagaactgggcttgaccggtctcggtgaccactacccgttccaattgtccggggggcaaaagcagcgggtcgccatcgcgcgggccctggcgatgaacccacggatcctgtgttatgacgaaccaactagtgccttggacccgaacctgcgtgatgaagtggccaacctcctcttgtcactgaaaaaggaggggatgacccagttagttgttacccacgacatggattttgccgaaaagattgccgacaagatcttgaaggtgcaagccttagacgccagaaagtagaaagggagcagtgggatgaaacgactgaaatacttatttgtcttggtcctgcttgtcattccggcggtcctcttgagcggctgtgagagtgtgacccagcgggccggcacccaggatacctggtcgcggattgaaaagcgggggaaggtaatcgtcggcttggacgattcctttgtgccgatgggcttccgggaacgggacgggaagttggttggatacgacatcgacttagccaaggccgttttcaagcagtacgggattaaggtggacttccagacgattgactggtcaatgaaggaaaccgaactgaaaaacgggacgattgacctgatttggaacgggtactcgatgacgccggaacgggctaagcaagtagccttttccaggccttacctcttaaaccgccaggtactggtcaccaagaaaaaggaccacattaacaactttaacgacatgaaggggaaggtgttaggggtacaaaacgggtcgaccgggatgaccgacctggatgaatacccgaaactgttaaaagacaagattaagggcaagagcccgatcctgtacgataccttcccgaacgcctttattgatttaaacgctaaccggatccaggggatcttgatggatgaagtctacgccaactactacatccaacaccaagcaaacgccaagtcctattcaacgtacattagtaacaagatgggcgccgattactttgccgttgggatgcgcaagggggacaagaccctgaaaaagaaggttaacgaagggctcaagcgcctccaagaagacggccagcttaaaaagatcaatgagaagtggttcggcaaggcctcgaacttcttgggcccggttaattacaagatcaagtaggttgtaatttaactggtaatcacgtatcatttgaaacggatcaataagaagacgaaagtgggaaataaccaagccggtcgcctggaggggcggtcgtaagccactacagcacgtagcggttgggtccgcacttggacacgcgggcgttggttagtgcttacgttttctgtcgagtattcggaaatacagtaaggggctgggagaaaacacggttttctcccggcctcgttttgcttaggaaaggaagaataatccttggacattcaattaaccaccggggttgatttgcacattattgccaccaagcagtttaaggtgacccggattttggtgaactttgcgaccgagcagcgccaaatttcaccgagtgcccggaacttagtggcgaacctgttggtaacctcgtcggccaagtaccgcacccaaacggtgttagcccgccacttaaacgacctgtacggagcctcgttgagcggctacgtgagccgggttggcttggcccacaccgtccgactcaagctagcgctgattaatgatcaggcagccaaggcccccctgtttgaacgggggagcgcccttttaaaggagctattatttaaccccctggtcgaaaacggcgcctttgatgcggaaacctaccgcctacagcaagccaacacgattgggaacttgcaatcttgggacgatgacaagcgtttttacgcccttaagcgtctgcaacaaacctactttacagagggggctgagttgcgccgcccggccagcgggacggttgcggaggtccaaaatataactagtcagcaaacctaccaggcctaccaagaaatgctggcccacgacaagattgacatcgtggtggtgggggacgttgacgaagcggccgtgtgtcaggccatgcgtgcgttggacttttccccgcgccaatctcccctgcaccaaagcctcttgtaccaccaagcggcccgccaaacaccagcctttgcaactgaggttcagccactggcccaggctaagttggacctggcctaccacctgcccgcttactaccggcaggacaactacctaacggcgatcgttttaaacggcctgctcgggggcaccccgtactcactgctgtttaccaacgtgcgggagaaggctagcttggcttattacgccaccagttcgctgcgggcctttagcggcgagattttggttgaaaccgggattaacccggccgatcaaacgcaggcgcgggcgctgatcgaacaacaggtggccgacctggcggcgggtaagtttaacgacgcccagttccagcgggtcaaggagggattggtgaaccaatacgtgacggggctagataaccccaacgtcttggcccaagctcgcttgatcaccgccttaatgggcctcgagccgtcgcaaaaggtggcagaggggctccgggcggttaccaaagaggaagtggccaacttagcggcccagatgacactagaggccgtctttttactcgacgggaagggaggagaaaccgatggagaagcttgattaccctgcttacgggcgggaactctataaaacgaccctcgctaacggcttgaagattaacctgttgccaatgccggattaccacaaaacctacgcgatcttaacgaccgatttcggttcggttgataacacctttgttatcgatggtcagcaacaaacggtacccaacggggtggcccacttcttagaacacaagctgtttgaaaaggccgatcacgatgcctttgacctcttcggagcgctgggggccgacgccaacgcctttaccagttttacccagaccagctacctcttttcgaccaccgcgcaccttcatgagagcctggacgttttgctggactttgtgtttgacccctacttcaccgaacaaacggtggacaaggaaaaggggatcatcggccaggaaattcggatgtacgctgacagtccggataaccggctgtacatggggaccctggggaatctgtacccggaggacccggttaaaatcgacatcgctgggagtgaggattcgattgccaagattaccccggagttgctgtaccagatccaccggaccttttaccaacccggtaacatgaacctgtttgtggtcggtaacttggacccggaccgggtagttgaatgggtacaagctaaccagaccctggccaactggccggcggcgcccctaccagtccacacctttgccccggtggacccccaggcaaacgacgtcgttccctttgcgaccttagagatgccagtggcccggcccaaggcgatgattggcctgcgggggattagcgactttgaaagtggccaggagcgcctccgttttgttcaatcgatcgggatggcgctggaactgttatttgacgacacgtcggaaaactacctgcggatgtacaacgaagaggtcttggacgattcctttggtttcgggctggagattgaacgtgggttccactttgccacctttgcgagcgaaaccaaccggcccgaggcctttgccgatgcgattatcgacattttaaggcgggcgcccggcgaactcgacgctgcaagggaccagtttgaagcgattaagcggggacaagtgggccgcctagtcgcttgcctggactcaccagaacagattgccaaccgcttttccggccacctctttgatcaggccacgatcttcgatgaattggcgtcgctggagtcaattaccttcgctgacctgcaaaacgcagtcgcccagttaattgtcccgcaacgactgagtgcctttttcgtccttccggaggggaagcaagaagtttaaactttattatgatttacgggcaagcccagcaatttcaagagagtatgctatacttggtaactgttaatactgtaaaaaagaatgaggaattaggtaatgagtgaaaacgaagaaagagtcaacgtcggcaaaaagctgcgggaggcacgggagaaaaagggcttaacgcttgatgacttgcaacaagccaccaaaattcaaaagcgctacctgatcgccattgaagacgaaaagtttgacgaattaccgggggatttttacgtccgggcctttgttaaacaatacgctgacacggtggggttagacggtaatacccttttaaaggattacgacgacgatctgccgcaaaccaagaccgccgagtattctaaccaccttgcccaagcggtggaaacccggactggcaaccgccaaccaaccgttgaccgggttgaccgggcgcgccgttacttaccaaccgtgatcattgcggtggtggtggtaattattttgggggcgatttgggcaacggcgatcgttcgtaaccgccaggacgccgctaccaagatcgattccagctccgtgtcggtttccggggaatcgtcgaaaaagtcgtcctcctctagctccagttccaagtcttccagctcgtcaagcaaggctgctaagctggaattcaccgctgcgaaccggacgacttcttccgtcaccctttcaactaccagtagtctgaccaaggataccgacatgacgattaaggccagcggtcaagcctggactagcgtgacggttgatgggactagcaaactttctaagaccctgacggctaattcgacgtcaacggtttccctgcccaagggtgcccaaaccgtggtcttgaccctggggaacgcaagcgcaacgacggttaagatcggcgaccaaaccctagacctgactgacagcggtaagtacgccaacacccggacggtgacgattaagtttggggcgacgacgaccgctagttccagtgctagttcaacttcaactagtgcggctagttccagtgtcgcaaccacgacgaactcaacgtcaacgacggcgacgactaacacttccacccaatcttcatcgacgcgctaaaggagttaatttgcaatgaatttaccaaataagctgaccgtggtccgcttaattgtaatcccgtttttcctgatcctgatggtgatccccttccactggggtgccgtcaccttttggggggccaccatcccggtgagccaattgattgcggcgatcctgtttatcgccgcgacgatcaccgataacctcgatggtcaaatcgcccgccgccagcacctggttacgaacttcggtaagtttaccgacccgctggccgataagctcttggtcatgacggccttcatcgtcatgacggggtccggggtggtaccggcctgggtcacgacgattattatctggcgtgaactagccgtgaccggcttacgcttattgatcgtggaacaaaacggtcaggtcctagccgccaagatgccgggtaagatcaagacgacgacgcagtttatcgcgatcatcttcttgttattaaacaacgtgatctttgccatgtggggaattcccttcggccaaatcatgctctacatctgcttattcttcacggtgtactccggggtggattacttcgtgaagggccgcggcgtctttgccgacgggttcaaataatttttcggggacgagaccaatttggttcgtccctttttgccattttgccgtatttattgattaagggggaaccgccatgcaagcggaaattatttctgtcggaaccgaaatcattttgggtcaaatcaccaacaccaacgcccgctacctcgccgaccagttgcgccagttggcaattgaggccccgtggcaaaccaacgttgatgatgaccccgcccgcatcaagcaggcccttgcaaccgccaaggaacgtgccaatctgatctttatttgtggcggactaggcccgaccgaagacgaccggacgatggcggcggtgggggactacttggggcgccaactacggctcgatgaagactactggcaacagatcaaggcccaactggaggcccggtcgatttccgcgaccgtgagcccagaaaacatccgccaggcctactacttagcgggggggaccccgctgtctaaccctactggcctcgccctcggggtctatttaaaagacggcgcccatacctacgtcgttttaccggggccaccgcacgaatttaagccaatggttgaccaatccctcttgccgcacctaaaggcggacttcggaaagggccaccagacttactccgcccttttgcacttcgttggccgcccggagtcgctgctaatgcaagagctggcctcactagggcttgacgaacgcctagtggtgacctcttacgtccagcctgatgaaattcaggtccgggtgacactccatgacgtggctaaagaagaagcgacttccttattggagcaggccatcgccaagatcgcccgacaagaggcggactactacattggccggggcgccggggtcagcatggccagccagctggtggccctcttaaaggaaaaggggcttaagattaccggggccgaaagtctaaccgggggcctttttcaagccaccctgtgctcggtggcgggggccagcgaggtctttgacggcggttttgtcacctacgcggcctcggccaaggaacaactgctcggcgttccggttgaaacggtgcgccaatacggggtggtttcgaagcaaacggcggaggcaatggcgagtggctgccaacaaaaaatgggcgttgacgtgggtctttccttcactggggtggccggaccggatgacttagagggccacccggccggcaccgtatggctcggcctggcgatcaagggacgccccgtcgaaagccacctcctccgcttgccggggcaaacacgccagttcgtccgccagcaaagcgtccaggaggggatgcgcctggcctacaacgccctacggtaactttccgaacccctgttcgactttttgcttgtcttttgcaaagaacctgatagaatgattaaagacacctacggatcaaaggaggaacacaagttggcagatcaacgaaaagcagccttagataacgccctgcgtaagattgaaaagaactttgggaagggttcgatcatgcggatgggtgacgccgccgacaccaagattgcaaccatttccagtggctccttagccattgacgaagccctcggtgtaggggggtacccacggggccgaatcattgaaatgtacggtccggaaagttccgggaagacgaccgtcgctctccacgccgtcgctgaagtgcaacgccgtggggggacggccgcctacatcgacgccgaaaacgccctcgatccccagtacgctaccgccctgggggttcaaattaacgacttgctcttgtcccaaccagacaccggtgaacaggggttggaaattgccgacgccctgatcgcttcgggagccgtcgacatcgtggtggttgactccgtggccgccctggttccccgggccgaaatcgaaggggaaatgggggacacccacgtggggttacaggcccgcttgatgtcccaagccctgcggaagctttccggggaaatcaacaagaccaagacgatcgccatctttatcaaccaaatccgggaaaaggtgggggtgatgtttgggaacccggaaaccacccctggtggtcgggccctgaagttctactcaaccattcggatggaaatccggcgcggtgaacaactgaagaacgggaccgatgtgatcgggaaccgggccaagattaaggtcgtgaagaacaaggtggcaccgccgttccgcaaggccgaagtagacatcatgtatggggaagggatctccaagacgggggaactgctcgatatggccgtcgaaaaggacctggtcaacaagtccggggcctggtattcttatggtaacgaacggattggccaagggcgtgaaaacgccaagcagtggtttgcggaccacgaagacgccatgaacgagctgatgaacaaggtgcgggtggcctacgggatggaaccggacgaagcgccggccaccaaggaaggcgaaccgcaacaagaaacgattgaagaagcatcgagtgacaaataatggacaaggggctaggagaaaaccgtcttttctcctagccccttgctgtattccgtaatggtaggtagaaaacgaggtcagccatgtcacctaagcaggctgttgaatttgttttttaactattacacagataacgtgctccccaaccacaggcctagtgtctaagtacggctgaagaacgctgcgtgccgcaacaaccttcatcctagcttagcccaacggcctgtcgaggaggttggttcgcacttccttttctttccaaatctcagcgaagttgattgacaccccatggcgggacgcttaaaattattttgtatgtgaattttttttgcattacttaaaattaatcaaacttttgaaccaacaagtcaatagttgataggaaggtgaactgatgaatgcaatcagcttattaatcgccgctgtcgctattgttgtcggtctaattgccggttacgtgggtaggaaaatcgttttcgaacaacgattaacccaggcgaaggaaaacgccgcggggattattgcaactgcccaaaaggaggcggcgacggcgaaaaaggaggccattttagaggcccgagaagaaagccatcgctaccgggaagtcgtggaacaagaactcaaggaccgtcgtagtgaggtccaaaaacaagaagagcgcttgctccaacgcgaagcaacccttgaccgcaaggacaccagtctggagaaccgcgaaactacgatcagcgcccgggaacggaagctcgatcaaaagacggagcagattcaaaagcgtcaacaacaggcagcggatttagtcgagcagcgccaagccgagctcgaaaaggtcgcccagctatcacacgaagaggccaaaaaacggctcctttcgcaactaaaagaagagttgcaaagtgaacgggaaacgatgattcggcaaagcgaacaagaagccgaattaacggcggaaaagaacgccaaggacttaatcgtggccgcaattcaacgctcagccgcggatatggttcaagaaaccaccgtgaccgtagtaaccctccccaatgacgacatgaaggggcggatcattgggcgcgagggccgtaacatccggaccttagaaaccctgaccgggatcgacctgatcatcgatgacacgccggaagcagtcgtcttatccgggtttgacccggtacggcgtgagattgccaagatggccctggagcgcttaatccaagacggccggattcacccggcccggattgaggaggcggttgaacgggcccgcaaggacatggatacccagctgcgtgaagtcggggagcaaacggtctttgacctaggcctgcacaccatgcacccggacctgattaagacggtcgggcgaatgaagtaccggaccagttacggtcaaaacgtcttacagcactcaattgaagtcgcaaagttagcggggatcatggccgctgagctcggtgaagacgtgaccctcgctaagcgggccggcctcctgcacgacattggtaaggccatcgaccacgaagttgatggttcccacgttgaactaggggtggaactaacccgtaagtacaaggagaacaaggtcgttattaacacgatcgcatctcaccacggcgacgtggcgccaacctcgatcattgccgtcctggttcaggctgccgatgccgtttccggggcccgtcctggtgcccgtagtgagtcgttggaacaatatattcaacgactcaagaagctagaggagttggccaaccaaaatagcggcgttgatcattcgtacgctatccaggctggccgcgagattcgcgtgattgtcaaaccaaccaaggtttccgataagcaagcggtcaccttggcccacgacctcaagcaagagattgaaaagcaacttgaatacccagggcacattaaggtgacggtaattcgggaaacccgggccgtcgattatgccaagtagagataggggagccgcagcattgctagcggctcttttgttctcttctaagagaaaatgatagaatgaaagcagtaattaaaaaggggtggcagtgtggcaagtaaacaaacgccgatgatggaacagtaccaacgggtcaaggatcagtacccggatgcttttttgttttaccgcttgggcgacttttacgagatgtttaacgaggatgccgttaagggggcccagttactggaattgaccctaacgtcacgtagcaagagcaaggataacccgatcccgatgtgtggggtaccccaccgggcggtcgataactacgtcgatatcctaatcgataagggttacaaggtagcgatttgcgagcaaatggaggaccccaagacgaccaaggggatggttaagcgggaagttacccggctagtaaccccggggacgacgatggacctagcgggggacgccgcccggcaaaataactacctaacggcgctcaaacaagagcaaggcggctacaacctggcgtacgccgacctgtcaaccggggagttaaaggtcactaaggtgtcaaacgaggccgccgccattaacgaattagttaacctgcaaacgcgggaggtggtcaccgaaccggaagtttcagcgagcctgcttgaccaactgaccaagcgcaacattttacgttcaacgcaagggcaagtggtgaaccaagccgaggtggcctacttgagccaagacctcacggacgccgggcaacgagacgtggtcgccttattggtttcctacctgttaacgacgcaaaaacgctccctggcccacctacaacgggcggtggcctaccaactctcttcctttatgaagattgaccaccgttccaaggtgaacctggagttgaccaccaacttgcgctcgggcaagcggcaggggacgctggcctggctcctcgatgagaccaagacggcgatggggtcacgactgttaaagcagtggttagaccgaccgctgttggaccaggcgaagattgagcgacgctacgaccgggtccaggagctactcgatcactactttgagcgtcaaaacctgcaagaagaattgatcaaggtgtacgacctggagcgcttggccggtcgggtcgcctacgggtcggtgaacgggcgtgatttgatccagttaaagacctccctggagcaggtacctaagattaaatacattttgcagacgttagacgtgccggcctttgatgacctggaacaggccttagacccccttgaggacgtagcgggtctgattgaccgggcaatcgccccggaaccaccgatctcggtcacggatggtggcgttattagggatggctataaccaccaactcgatgaataccggggcgccatgcaaaacggcaagcagtggattgccgacctgcaagaacaagaacgccgggcgaccgggatcaataacttaaagattggctacaaccacgtctttggctactacattgaggtcaccaaggccaatatcgacaagttacccgctgaccgctacgaaagaaagcaaaccctggtgaatgcggaacgctttgccaccccggaactaaaggaaaaggaaagcctgattttaggggcgcaggacaagtcaaccgccctggaatacgagctcttcgtgaaggttcgagaagccgtcaaagaacagattgaccgcctgcaaaagctggcggcaaacctggcggccctagacgtcattcaggccttcgctaaggtggccgaggactaccactttgtgcggccaagcctgaatcacgatcaccagctgcagattgaagacgggcgccacccggtcgtggaaaagttcatgggccaccaggagtacgtgcctaacgacgtcttgatgggtggcgataccagcatcctgttgattaccgggccgaacatgtctgggaagtcaacctacatgcgccaactagccctgacggcggtgatggcgcagatggggtgcttcgtgccagccaagcgggcccagctgccgatttttgaccaaatcttcacccggattggggccgccgatgatttggtatccggtgaatcgaccttcatggtggaaatgatggaagccaacaacgccctgcaaaacgctaccgccgacagcctgattttgtttgacgaaattggccgcggtaccgctacttacgacgggatggccttagcccaggcgattattgagtttgtgcacaaccgggttggcgccaagaccctgttttcaacccactaccacgaattaaccgcccttgaaggcgaactggaccacctgcaaaacgttcacgtcggggcgaccgaagaaaacggcgagttggtcttcttgcataaggtaaccccggggccagctgataagtcctacgggatccacgtcgctaagttagcggggatgccgacgccgctcttaacccgggccaaccaaatcctaaccagcctggaggggcaagaaacggcggcggttccttcgcggggtgtcgaaccaccagcaccggtgatagaaccgacgccagcaaaggagcaaacgccggtcaaagagcaaacgaccccgttagtcgaggagagtagcggtcaactcgaattgtttgccacggccccggtcgaaaaaaaggacggtaaggccgataaacttgcccggcaagttaagaacttggacctgatgagcatgacgccgatggacgtgatgaaccaggtttacaagtggcaacagaatctaaagtaacaaggaagggaacacgatgggcaagatccatgaattagacagcgtcttagccgaccagattgcggccggcgaggtgattgaacgccccgcctcaatcgtgaaggaattggcggaaaattccctggacgctaacagccaccgaatcgacattatcgttgaagaagcagggctcaagagcgtgcgggtgattgacgatggccaggggatcgaagcagacgacgtggcccgggcctttttgcgccacgccaccagtaagatcgccgataaaggcgacctctttaaggtgacgacgatgggttttcgcggcgaagccctgcccagcattgcttcggtagcggatgtcttgttaaccacggcgactggcggggcggcgggcagccagatccacattaaggggggcgagatcctcgcccacggccaggccagtgcccgaccggggaccgacatcttggttagcgacctcttttacaacaccccggcccgcctcaagtacttgaagtcgccccacaccgagttagcccggattgtggacatcgttaaccgcctcgccctggccaaccccaccgtggccttttccttgacccatgacggcaaggaggtctttcgctcggcagggaacggtaatttaaaacaggtcgtcgccgctatttacggggtccaagccgggcgtaagatggttgaggttaaaggagaagacccgaacttcaaggtatctggtttggtctcgttgcccgagttaacccgggccgggcgccagtacatgacgatcatgattaaccaccgctacgttcggaacttccagctgaccaaggccctagtggccggttaccgctccaagttaatggtgggccgctacccgctagcggtgatcaacattgacctcgatccggtgctcgtggatgtcaacgtccacccggctaaacgggaggttcgcttgagcatggaaccccagttagtggacttacttgagcgggtcgtcagccaggccatcgaccaacagaacctgattcccgacgttggtgaccgggccgacgaacttttaaccagggagcagaccgttcacgccccgagaagcgccgccccccgggtcagcgaacgggccagcgacgagccgccggcctggcagcccagcccgaccagtggggaaccggtgattattagtcgccgcagcgaattagctagcccggcggtgcaagcctttgaccggcgctaccaaaatgaagaagtggcgaccccctttggcgcccaggcggacgcgaaggttagccaggcgcaaccggcggtggaacaggtgagcctagacatcgacgaccggggcgacgtcgcgagcgaacgtttcccggaccttacctacctggggcagctccacgggacctacctgttggcccaagcctcagatgggctgtacattgttgaccaacacgccgcccaggagcggatcaattacgaatactaccgtgaagagattggcaaggtctctgccgaccagcaaaactttttgacccccttggttttaaactactccttagccgacgccttaaagatccaacaacaccaagcagtgttagccgcctgcggcctaaaactagagccgtttgggcaaaacagttttatgctcgctagccacccgacctggtttgtggcgggccaagaagaggataccgcccgcgagatgatcgattgggttttggccagtggcaagctgagcgtcaaggacttccgggccaaggcggcaatcatgatgtcttgcaagcgggcgattaaggccaaccaccgtttggacgaacgccaggccaaggcactgttggcccgcctgccccagtgtgagaacccctttaactgtccccacggccggccggtaacgattcactttaccaccaccgacttggagaagctctttaagcggatccaagagtcccaccaaccctttgccgacgactttgacgaccacgaggactaaggcgaacaggtgtgctaaaataggggaacgaagacgaaaggtaaggaacacggatgtttgaatatttaaccggtttaattacaatggtcagccccgattttatcgtggttgacgtcaacggggtcggctaccgggtggcggtggccaacccctacgcctaccaagaagacgatcaacaggccgtccaggtctttatttaccaagcggtcaaagaagacgccattaccctctttgggttcgcaacccaggccgaaaagcgcctgttcacccagctaattggggtctccgggattgggccgaagagtgccctggcaatcttagccactcccgaccaccaggggctaatcgacgcgattcaaaacggcgacgataagtacctgagcaagttcccggggattggtaagaagacggcctcgcggatcattattgagttaaaggacaaggtcgtggcggttcaagacgaggtccaactcgacttcacggccccagggccactgggtccgtccgcggcactccaagacgccttggcagccctggagtcgctagggtacacgaccaagcaagtcgaacgggttcaaaagcaattggaaggcttgcaaggcgagctgtccaccaacgactacctcagccagggcctgaagttgttgagcagataaggaggttttcatggaacaagactttgatgacgttctttcaaatgaggtcactgatgaccaggaggggcgagacgaggttagcctgcgcccccaaaccctggcgacctacatcggccaagcgcggatcaaacatgaactagcggtctacattcaggcggctaagtcacgcggggaggccttagaccacgtcctcttgtacgggccgccggggttagggaagacgaccctagcaatggtgatcgccaacgaaatgcaagtggccatcaaaaccacctcggggccagcgattgaaaagccgggtgacctggtggcactcttaaacgacctcaaaccggggaacgtcttgttcatcgatgaaatccaccgcctacccaaggtggtcgaagaaatgctctactcggcgatggaggacttttacatcgacatcgtggttggcgagggtcccacggcccacccggtccacttcccgctgccgcccttcaccctgattggggctaccacccgggccgggctactagcggcgcctttacgggaccggtttgggatcgtggcccggatggattattacactactacggagctcagccaaatcattgaccgttcggcgaccatcttcaacactaagattcaagaggacggggcccacgaactagccctacgctccaggggcacgccccgaattgccaatcggctcttaaagcgggtgcgtgactttgcccaggtgggcggtcaggcggcaattgacccggccacggttgaccgggccctagatttattggccgttgatgaccaggggcttgatgagattgaccgcaagctcctcaccacgatgatcgagcactaccacggtggcccggtggggatccggacgattgccgccaatattggcgaagaggtcaacacgatcgaagagatgtacgaaccctacctccttcagatcggctttttgatgcgtaccccgcgggggcgggtggtgacccctgcggcctacgaacacctcaagataccctttgaccaggaggaaaattaacatgaccatgactagctaccccctaacggtcccgatgccggtattaaagctccccctcttgaccaccgatccgctaaccgccggggagttattttcccactgtggggtccggatcgtcgccttaccgctagcaccggccatggacgcccccggcgcggccaccctgggggaggttggcggcctcggtgcttggctcaagtgggaaggcctcaccgttgccctccccgggttcggtcagcccctaacgaaggtgaagaaaaacagcgaacgggtcggcgtccactaccaactcccccatgggggcgccaagaaaaccgttaacggtgccgaatacgaggagtggttaaaggcagcccacgcttcggtggcccttccgttaagccaggcgcctgaccactacgccccggttgacgacatcgtgcgctccgtggcggtgaacgccgcctggggcgctcaaacgccaaccgggtggggcgtcgtgcagggggcggggctaaaggccgcccgccaggagagcattgcctacttggtcgagcaaaacattaccaacttttacctgggcggctttgagcaaccactcgaagacgaggagtggcaacggagtttggagatgaccactgacttgttaccacccaacggcttggtgatggttgaagcggcaacgcccttccggattcaggcggcgattgaagcgggggtccacttgatcatttccgatttaccgctgactttggcgcgccaccaccgttacctgcaagaagacctcagcgacgtgccggtcgaagaaggggcgccgcatggtttacccaagcaagcctggccctacttaaccgagcgccacgtcggcttagcaacgcgcctgttgaccgaggctaacgtgaagaactggacggcttactttgcgaaaaaacaccgggaaatgttaaattaactggtatttaagctggtttttggtatagttaaaatattactaagattaacaccagaagggatgaattcttgtgaacgctaacatgtcaagcattattttgatcgtgctgatgatcgccttcatgtacttcttcatgatccggcctcaacagcgccaacgaaaagaacaccaagcaatggtgaaccaattgaagccgggtgatgccgtggtgacgattggtcgcttacacgggatggtccacgaagttaatacggccgaacaaacggtaacgattgactgcgaagggatttacttaactttcgacctgtccgccgttgccaaggtcaaccgggcaacgccagctccggccgctgcaacgaccgtgactgaagcaccagttgaatcagcttcggccaacaaggaagcggctgctcaggctgaagaagaacaagcgcctgcttcggctgcaaccgacgctgacgacgaaaagccagcggaacaagccgaaaagtagtacgcaggccagcagaacaatttaaaattcggtggccccgcgctaaaaacgggattgggctccagcttggttcgggatttccggacggctggggcccattcgcgttcttggcgaatgaagttagggccgagaagaggggaaagtcgggcggtgagtttttggttcgccgtcaaaaactggtatactaagaaccggttaccccaagcggacgaaaggaagattacgatggcagacttagatgcgatctttgaacaaattaaaaagtacaaccggatcattatccaccggcaccaacgcccggatccagatgcgattggttcacaggtgggcctagcgtcgattttacgggcgtcttttccctacaaggaagtggcagtcgtgggtaaggaaatccccggttttaactggatcggccagatggacgacgtcgacagtagcgaatacgatggcgccctggtgattgttaccgacacggccaacgccccacggattgacgaccggcgctttaataacggcgatgagttgattaaaattgatcaccaccctaacgacgagccctacggtgacctcatgtgggtcgatgaccaggcgagttcttgttccgagctgatttacggtttttaccaacactttgctaaggaactaacgatgaccaaggaggcggcaacggctctgtacgccgggatcattggcgacacgggacgctttttgtacccggccacgacgcccaagacgatgctggtggccggagccttaatggccgccggcgcggatgccgccgccatttcccagcgcgaaaacgaaatttcgctccccctggcccggttgtccgcttacgtttacgaacacttaacgattaccgacagcggggcggggagcgtcttattaaccgatgaagtcctcaaccaatttgggctgactgaagccggcacctcggccgtcgtttccctgccaggacggatcaaagacgtcgtggcctgggcaatctacgtccaacaagaggatggcggtttccgggtgcgcctgcgctccaaggggccggtgattaatgaattggccaagcgccaccacggagggggccacccgctcgcctccggggcccgggccaatgacgaagcagaaatgaaacaaattatgcaggaactggatgagttaacgacccagtttctaaaaggagaactttaatgattgaatcttttgcggaccttcacttggccgactttttaacgccggctctaaaggaccttcactttgaacgaccaaccgccgttcaagcccgggtgatcccgttgatcctcaacggtaagagcgtggtgggccaatcacgaaccgggagtgggaagacccatgcctttttgttgccgatctttagccaactagcccccaacaaccagacggtccaagccgttatcaccaccccgtcgcgggaattagcctaccaaatttataacgccgccaagcaactaaaccgctttgcgaccaccccgttgacgattcacaactacgtcggtgggaccgacaaggagcaccaagtcgaacaattgaaccggcgccaaccccaactggtgattgggacgccggggcgaatcttagacctgattaactctcaggccttagatatccacacggctagccagttcgtgatcgacgaagccgatatgaccttggacatgggctttttagaaacggttgaccaaatcgccgcccgcttccccgaaaagctccagatgatggtcttttcggccacgattccccaagggctacggccatttttgaagaagtacttggaaaacccggtgattgaagaaattcccaccgaaacggtcatcaaccccaacgtggaaaactggttgatgtcgaccaaggggcgcgacaaaaacgacctggtctaccgcctgttgaccctaggggacccgtacttggccctggtctttgccaacacccgtgaccgggcgacagaactggctaactacttgcaagaacggggcttaaaggtcgccctgattcacgggggactggaaccacgggcacgcaagcggacgatgcgccaaatccgggacatggactaccaatacatcgtggcgacggacttagccgcccgggggattgacctggagggggtttccttagtcttaaacgatgacattccaagtgacctggaatacttcattcaccgggtcggccggacgggtcgggcgaacatggccgggaccgccatcaccctgtacgcgcccgccgaagacgtcctgattgaaaagttagaggaacggggcatcacctttattccaaaggacttgaaaaacggccggatcgtcacgacttacgaccggaaccgccgcaaggcccaccgccgtaagaaggcggccttagacccgaccgttaagggctttgtcaagaaggccaagaaaaaggtcaagccgggctacaagcgccgcatcaagcagcggattaaagaagacgagcgccaaaaggttaagcaggcccagcgccacgaaatgcgcaaggcgaagcgggctcggcaaaaacaacaccgggcggagcgggctcgtcaacagaatgggcgttgattttgccccgccccttggttataatgaaacacatctgggacatgaccggttgggggaacttttagaaacgtgctggtggctgcaaagcacgacgaaccaaaccaggttgctccccaggggataatttagtgatcaacccccacgggggattaaaagtggcaaacgaatccatcgttgcaagcagagtggtaccgcgtcgaccggcgtctctgtctagcaggggtggattttttgttttagaaaggaaaggcaatgaaagaactgaaaaaactgaactccgcccagattcggcggatgtacttagacttctttgttcaacacggacacaccgagatgccgtcacgctccctagtgccggttaacgacccgaccctgctctggatcaactccggggtggcaacaatgaagaactacttcgatggtaaggtggttccggacaacccgcggatgacctcttcgcaaaagagtatccggaccaacgacattgaaaacgtggggaaaacggcccgccaccacaccatgtttgaaatgatggggaacttctcggttggtgactacttcaaaaaggaagccatcacctgggcctgggaactgttaaccagtgacgaatggtttggctttgacccggaacgcctctacatcacttactacccgaaggataacgacgcccaccaattctggctggacgccggggtcaaagaagaccacctcttagccgaccaggataacttctgggacattggccaggggccgtccggtccggacacggaagttttttacgaccgcggccaggaaatgaacaacttaccggaagacgatccggaatcctatccggggggcgaaaacgaacgctacctggaaatctggaacatcgtcttctcccagtttaaccacaccccagaagacacttacgaaccgttaccgaacaagaacatcgataccgggatggggctggaacgggtcgtttcgatctttgaaaacgccaagaccaactttgaaaccgacctcttcatgccgctgatcaagcaggtagaaggcttctctgccgacaagcagtatggccaaaacgccgccgatgacgttcagttcaagatcatcgccgaccacatccgttcgatcacctttgcgattggcgacggggccctgccatccaacgtcgggcgtggctacgtgattcgccggctcttacggcgttcggtggtggccggcaagaagttagggattgacgaaccgttcctagctaagatggtacccaccgttggcgaaatcatgaaggactactacccagacgtcttagaaaacgccgactacatcgcctcagtgatctcctctgaagaagaccgcttctccgccactttaaacggggggctgagcctgttaaacagcgtgatcgatgaggctaagcaaactgatggcaagcaaatcgacgggaaaacggccttcaagctttacgatacctacggcttcccggttgagctgacccgtgaatacgcagccgacgagggcttgaccgttgacgaacagggctttgaagcggcgatgaccgaacagcaaaaccgcgcccgcaacgcccgtgacatggacaacgggatgggggtgcaaagcgacctgtggaccaacttcacggacgaaagtaagtacgtgggctacaccgacctggtggttgataacgccaaggtaatcgggttggccgccgacggtaaacaagctgaccaagcggaaccgggtcaacaagtcgacgtcatcttcgaccagaccccgttctacgccgaaatggggggccaagtagctgacaccggtcaggtcatcgataactacggcaaggtggttgccacggttaaagacgtccaacacgccccacaccaacaaaacctccacaccttagagttaaccgccccaattaagaagggcgcccgctacaagttagtggtggaccgggcccgccacctcaagattgaaaagaaccacaccgccacccacttgctggaccaagccttacgcaacgtcttgggcggccacacccaacaagccgggtccttagtggaggcccactacctacgctttgacttcaaccacttcggtcaggttactaaagaggaccttaagaaggttgaagacatggtcaacgaacagatctggaaggaaattccggtcacgacggtcgaaaccgacattgattccgctaagaaaatgggggcaatcgccctcttctccgacaagtacggtgacaaggtacgcgtcgttaagattggtgatttcaacaccgaattctgtggtggggaccacgtcaaaaacaccaacgaaatcggcctcttcaagattgtttccgaaggtggggtcggcgccggggtccggcggatcgaagccgtgacgtccagtgacgcctttgccttcatgcaagagcgggtcgacagcctagaccacatcgccgccgacctgaaggtggctcaagttaaggaagtcgcccaccgggttagtgagttgcaagaccagctcaaggaagccacgaagcaaaacgaggccctgcaagctaagttagccgcccaacaagccggcgacgtcttcaaccaggcagaagaaacggcgaagggaaccttgattgccgccgaagttaaggtggccggaatggaccaattgcgtcaaatggctgacgattggcgccaaaaggattactccgatgtcttggtcttagccacggccgctggtgacaaggccaacctcttggtagcagtcaaggatggcctggccaagacggtcaaggctggtgacttgatcaaggcaatcgccccggccattaacgggggcgggggcggtcgcccaaccctggcccaggccggcggaaagaacccagccgggattagcgaagctctcaagctggctagccaattcatgaatgattaagggaaagtcgacattttcctccttggtagactggatttagacactaagtccgcggggaatttcctggcatcattacgaaataaaacccctcaccggcttgcgcaagctggtaggggtttttgtttggccccatttccggggggctaaattgtacttttggtggggatatagtacaattagcaatggtacatttgatggaggtgactgaaatggcaactgatgaaacgatgttttttgactttgataagttgcacgaaaaaaacgtcaaagagacccttaagacggtctatgatgcccttgaagaaaagggctacaacccgattaaccagatcgtgggttacctcttgtctggtgatcctgcctacattccgcggctaaacaacgcccggaacttgattcgccagcacgagcgcgatgaaattatcgaagaactcgttcggtcctacctgaagaacagcggggacgttcagtaatgcgcttattaggattagacgttggctccaagacggtgggggtggcggaaagcgatcccttgggctggacggcccaagccgtggaaatcatccccattgatgaggaagcggaggtctttggcttagagcgggtggcggaactggttaaatcccgtcaggtcgctggctttgtgctcggcctacccaagaacatgaataacacggagggaccacgggttgaagcggcacgccattacggtgagctcttggaggagcggtttggtttgccaatcgactatcaagatgagcgcttaaccacggtccaagcccaccggatgttagtcgaagaggctgacgtttcccggcgcaaacaaaaaaaggtgatcgacgaattggcggccaccttaatcttacagaattacttggatcgccacggtaagttgtgcgccaagctataggaggaattgtcatgagtgagcaaacgccacgcgatgacggcgaaatcttcaccctggttgatgaagccggcaacgaagaattatacaaagaggcaatgcgtttccaatcaccggagacgggcaagtggtacatctgcctctacccgctggacgaagaaaacgacgaggaggttgggattcaggcctttgcctttgaagaacctacttcagaagaagacgagttagaactattgccgatcgaaaacgatgccgaatgggaaatggtccaagaggtgcttaacacctttatcgatgacgatggtaattttaacgcctaatattataagaggctgggaggaaaccatgttttcccccagcctcttgctgtatatccggatgtgctagtttgagcagtagtttaagtgggggccgccgaaacaagacggaagctttccctattttattggcgagccagctggcgggccttttgggtgttagcgaagtggaccttggcaaactggttgaggtcgaggcccttgcggattagcttggcggcgattaagtcgacggcgtgaccggccccaattggcagggtgatgccggcttgttcagacagggtatccattgccttcaacgattggtagcgggcgacaatcgaggccgctgccaccgccacgtgagcttgttcccccttggtttgaaaataaacgtggtggctaacaatctgtggttggccctgcaaataattaaagtaggtccgttcactgacgaactggtcaatcaagatggcctgcggcttggtggctaaccgttctaacgtcttagcgagaacgtagttgtggcacagggcctttaactgggcctggttatactttttcatgcgggcgttataggccgcgggcatcaagttgaggtaggtgaccgggcaagttgccatgatctgtttggccaagcggatgatttccgggtcggttagttttttggaatcggcgacgcccagctgggtgagggaagcgacttggtcggcggcgacaaagacggccgccgtggtgagggggccaaagtaagagcccaccccgacctcatcggaccccaagaccgaccaggtggcaaaaccggcgggtaagccagccggggcaggtgtcgaacgcgagggggctggggcgtcgtttggttgccaccgggcggcctcttggttggcaagggcgccctgaaacatcaccttgtggctcttggtgtagccggtcacggtgacccccttcagcttggcgtgaaaggacgccccggccgggagggttcccggggcctggtaggttgacttcatctgttcaaaggtcggtgtatcaacgttaattacgatgttcatgttgctcccctttctgttgcaatccctacgatagcaaatccggggtgaaaatgctaaaatattcagtgaaaatttaggagggaacacatgatccttaccgccattatcatcatcattttaatgggttgttggattcacggccgccggatggggctgatcggcctggtaattacgacggtcgcttattttttggcgtggttgatggcccggctgggggcccggtttgtgggggccgcgttggctggtatcttaccgtcgatcaccgacagcaccaattcaacggtcacgagcctgttaaagacgagcaccagcgagtttttctacagtggggtcagctttatgctgatcttttgggcgatcacctttttctcccgctggttgttgcaccgctttaactgggtccgccaggttccggtggtcgggacggttaacggctgggccggcggggcgctagattgcctgttggggtatttaatcatcttcgtctttttgttcatcttccagcttctccccgttgattggtggcaaagccaactagcagcgtcgggattggcccagtggatcattaatcaaaccccggggatggccaaggtggtcatctcctgggtcatttaaggaggatcgatttgtcaatgaaccataaaattttagaaaccttagagtacggccgggtcaaggggcagctcgcccagtttatcgtttcggccacgggacgggcggaactggctaagctcgaaccccaaaccgattacaccaccattcaccattgggtggaagaaacggaggatggggccgacctattacgtttggtcgggggaattcccctgccggagttagccgacgttagcccccaactcaagcgcttgaaggtgcaagccagcttaaacgggaccgaactggcccagatcacccaggtcttgcggaccagcatggcggtgcaaaacttttttgagggcctagtcgaaaagaaaattcgcttgcggaccattgataacctggcgacgtcattggtgacgattccggaggttacccggcgcctcgctcgctcactggatccggacggccgggtgaccgatgaggcatcaactaagctacatggggttcgtcagttgatcacccaaaccgaagttgatattcgccacgaactggagcgttacacccggggcaagcaggccaagaagctgtcggacccgattatcacgatcagaaacgaccgctacgtaatcccagtcttggctcagtaccgcaaccagtttggcggggtggtccacgaccaatcagcgtccgggcaaaccctctacattgagccggggagcgtggtggagttaaataaccgcttgcgccaagcccaaattgaggaacgccaagaggtacgtaaggtcctagcggagttatcagacctggtgcgcccctaccgcaacgacatcgcgcaaaatgcccagttgctaggccacctcgacttgattaacgccaaggccaagttggcggcggcgatgaaggcgagcgtaccgcttttaaaccaggagggtgaggtcaacttacggatggcccgtcaccccttgatcgaccaggagaaggtggttgccaacgacattgccctgggtaaggactaccaggcaatcgtgatcacggggccgaacaccggtgggaagacgatcaccttaaagaccctgggcttaatccagttaatggcccagtcggggatgtttatcccggccaacgaaaactcgatggtcgccatttttgataacgtctttgccgacattggggatgagcagtcgttggaacaaaacctgtcgaccttctctggccacatggaaaacgttaagcggatcttagaacaaatcaccgctaactccctggtactcttggacgaactgggggccgggaccgaccctaaggaaggggcggccctggcgatggcaatcctcgaccaaattggggcaacgggtagcgaagtcgtcgtgacgacccactacccggaactgaaggtctacggctacgaccgggccaagacaatcaacgcctcaatggaatttgaccagcaaacccttcagccgacctacaggctcttacttggggtgccagggcagtccaatgggatcgcgatcgccaagcggctagggattgagcaagcggtcattgacgaggcctcatcgttggtctctgatgatagccaggacttaaacaagatgatcggtgacctggtcgaacaacgcaagcgggcccgggaggaaaacgaacggcttcaggcgttagttaaggaaaacgcggccaccaaagaggagttagacgccaaactcgatcgctttaacgagcagcgcgataagctcttggaacgggcccgttcggaggccaaccacgaggtttcccaagctaaaaataaggccaaccagattatccaccacctccgccaactagaaattcagggcgccacggttaaggaaaatgaattaattgacgcccagggggccttaaacgccctacacaaggacaacccacgcttaaatcacaacagcgttttacaacgggccaagcaaaagcaccaacttaaggtgggggaccacgtcaacgtcaagtcctatggccagcaaggggtcttgttaaacaagcgcggcgcccataagtgggaggtccaactgggcattttgaagatggccattgacgaggccgacctcgaaaagatttcggctaagcaggctaagcaagccgagaaaaagcacgctcagccccggcgaatggcggtgcggacgattcaaacgcggcaaaccagtgcccagttagacttgcggggtcaccgttacgaagaggcgatgagtgaactggcgtcctttattgaccacgccttgttaaacaacttgccgtcggtaacgatcatccacgggaaggggaccggggccctacgtaaggggacccaacagtacctccagagcaacccccgggtaaaaaactttgaatacgctagccctagcaatgggggcgacggggcaacgatcgcctacttttagcgggtgaattggggcgccggaccattaaataaatggtaaaataggggtaattaaacaaagggggtttggagcatgtcagtacacgaaacaagtgacgccacttttgaacaagacacggcgaccggcgtggccctaattgatttttgggcgacctggtgtggaccgtgccggatgcagtcaccagttgttgaagccctcgaccaggaaatgggggagcaagttggttttcacaagctagacgtggacgctaaccccaacgtggccgaacagtttcagatcatgagtattcccaccctaatgattaccaaggacggccaggtagtcgaccaattaatcggctaccacagcaaagagcaggtcgcccaacttttaaaacaatacctctagtcataagggggacgctggttagaagcttgtttctaattggcgccccccttttcgattttcttaaaaattggaccaggacttgtaatttttccctaagcgcgcttaactaggaaggtgtgaattttagtgaaatggggaatgacggatgcaactccgacaacaactacaaaggaacctcccgattattattgccacggtggtaatcggggtgattgcggggaccagttcagccttactaagtctctttttggaccacgttgagcacctttttttgggctttcaagagagtaaccggatgccggtgaacctggacgccagcgctattcaccggggcttgtcggtaatagcgggggggatcctagctgggttctcttggtacctcctacaaaaaaagggctaccgtccggtggggctagctaaggccgtggaaggacaacggatgccccttttccgcacccttgcccacgtcttaacccagatcttcttcgttgggaccgggggctcaattgggcgtgaattggcaccacgggaggccggggccgcctttgcccagaagtgggaagattttgctaaccaacaccccgctttaacactggaagacgacgataaacgcttgttggtggcggccgctgccggagcgggctttgccggggtctacatcgccccgattaccggcgccttcttttgcatggaactactctacaaacgaattaccccacgggcgatcgccgtctcgttgaccatgtcttcgatcgccaccatgattggtgctttggtcaagggttacgttccttactacctggtctctgaccgggagctttcgttacgcttgctcccctacgttatcgtggtcgccccgttaatggggtggttaggccacctctttgggcgggcgatcagggcttgtagcgccaagcgaccccaccaagtcaaactattggtgctctttccaatcgtcggcctggtgaccgggttagtggccgccgtttacccccaaatcatggggaacgggcgggggttagcccagttggcaatgtcgacgacggcaccgagccgcatcgctatcgtggccctgttctttggtttggtggccaaaccaatcgtcaccctgatgacgattcgttttgggggctacggtggggtcttgaccccgtccatttcaattggtgcctcactgggggtcttgctagggatggtgtacgccattattgtgccgggcatcccactcgcccagttcgccgtggtcggggcggtcgcctttttgacctcctcgcaaacggcgcctttaatggccctctttatgctctttgaagtttgccacctggctagcggttcctttttgatgctagcgctagcggcgggtttatcgatcgccgttaataagtggctgagtgcggcgagcaactaaaaaaagaagctggaaaattccagcttctttttttaatctctgtggataaggtagtcaccgttttagcccacggcccgtttaacggtgggggtcgcacttcctatttctttttctttcgcccaaacaagccggtacgcttcttggacgtgggttcttcggtagtcggcatttgggggtggatgaattcaacgagttcggtgcgttcggaatcggaggtgtcttgggggtcgttttgaaccaggaaggtggcggtgtggcggccgcgttcttggacctcggcttcggcaaccgagcccagttggaattcaatttcctgggctaaaaagccggcttccagggcaaaggaggtggtttccttgtcgagggtcaagcgctcgtcgacgatggggccgcccagctcccaaatttgctgggtggcgctccgttttttcaggcttaattcgcccatgcctagttggttagttaagacgatcagttcttcttcggtggcaaccgggtattcacgggccaggtccttaccgatccagtagaggatcccctccgtttcggttcctaaaagggcggggataatgatgtcacgcagggtggcggctccaagaccccggtggctgttaatgaggtggtcgtaacgtgtttgggtcattttaataacttctttctttggaaatctattttattataccggaaatcggcagccgggcgagggacttaatgaaaatttaggggcgaggattgcaaagcagctggatttgggcgaaaataaggtttcaacctgttgaaaaagagaaagggtgaacataaaatggacaatcgcccaattggagtgatggattctggcttggggggcctttcagtcgtccgggttatccagcaaaaactacccaacgaagaggtcatcttcgtgggcgaccaaggtcacttcccgtacggaaccaaggatcaagcggaggtccgtcaactggcgctttcgattggtgcttttttactcaagcatgacgtaaagatgatggtcgtggcctgcaatacggcgacggcggccgcactgccggccctgcaagcggcgctcccaattcccgtaattggggtcattgagcccggcgcccgggcggccctggcccaggataaaaagggaccgattggggtgatcgccaccacggcaaccaccacggccggcgcctacccagctacgatcgaacggctagcgccgggtaccccggtcattgcaaaggccacccagccaatggtcgaaatcgttgagcacggccagaccgggacggcgaaggcccaagaagtggttagtgaacagctaatgacctttaaagagcacccggtaaaaaccctgattatgggctgcacccacttcccgtttttggccccggaaataagtaaggcggtcggaccaacggtggccttagtcgacccggctaaggaaacggtggccacggccaagtcctggctggagcagcaccaagcaatgggtaaccacgcccaccccaactaccacctatattcaacgggcaacctccctgacttaagggccggggtgaataagtggttgttgtcggggcactttgacttaggaaccgcccaaattgaagagggggattaacgtgttaacactcgtcgttgcaactaacaaccccggcaaggcccgggaatttcaagaaatgctcgcacccatggggatcgaggtcaaaacgttggccgacttccccccatttccaattatcgaagatggaaacagttttgaagaaaacgccctaaaaaaggcccaggcagccgtttcagccctcaacttaccggtggtcgccgacgactcgggcttgatggttgacgccttagacggtgagcccgggattcactcggcgcgctatgccggcgaccataatgacgccgctaataaccaaaagctcctggccaaattagctggggtaccggatgaagagcggaccgcccatttccacacgacgatcgtgggcctaaagccaaacggcgccaagctagtcgccaacggccaagtcaatggtcacattcttcacgaattaaccgggacgaacggctttggctacgacccgctcttttacgttgacgaattggcaacgtcgatggggaacctaacggatgaacaaaaaaacgccattagccatcggggacgggcgctgcgggcgttgatggcagactttgaagaatggtgggagaagtaatgaaggcactatttattagcgataaccatggtgacgccgctattttagagcgggttaaggaaggcttggcggatcaagttgacgctatgtttcactgcggcgattcaaacttatccccggatgacccagccttagccggttttcaagtggtggtgggcaacaccgattgggatcccttcccgcgggtggtggaccaagtagtgggcgatgagcacgtcttcgtgacccacggccacctgtatggcgtcaaccagagcttgttgaacctgaagctagcggccaaggaagcgggcgctacggtggcggcgtacggccacacccaccaactggcttgccaggtggtggacgggatcttgttgttaaacccgggctcaattagccaaccccgcggcgagtacgattacctgggcggcacctttgccacggtagaaacgacgcccgagcacttcatcgtgcgctacttcaaccgcgacctggtcaacgtcggcttagataagcgcttgaaacgataacagaggtgtagggggaaacggagcttttcccgatccctcaaattaacaaggggctgggagaaaacacagttttctcccagccccttgttgtattcccgaatgctagacagaaaacgtagtcaataaccgcagacctagtgcctaagtaggcggaagaacagtgcgttccgcactaaccgttcgtcctagcttagtcatacgacctgccgagaaggttattttccactctcttttgcgtttatttaattcgttggtcgagcagggcgttaatggtccgcaaaacgccgctctcattattggtgtgggtagtgacgttagccgcttgtccttgaatgaagggcgccgcgtttttcatcgcgtaggattggggcgtcattgtcaaaaggccaaggtcgttttcgttatcgccaaaggtcaccacgtgctcagcctctacccgttcttggtcggtgagggtcagtagggcgccctgtttagtggccgaagcgaggccgatttgtgaggtgtgaaagcccgagttttccagggcgaggccggcgggtaagtgagcggttagccaggcggtggccgcttgccagtcaacggtcgggctaaaggtcaccgagacccgggttaattggtcatcgaccagggttgccacctgccgcaagtccgaaacggcgatcaccttctcataaaaggttttaacgattgcccgattagtgggggacatcgactggtcaatgtaagaggcgttaaccccggagactaccagttgtgctagttggcccgctgcaaagtggtcggtgattagggctaggacgtcggtgattagggcgttggttagggggctaaccgatagcagttggcgccccaggtggacgaccgccccgttttgggagataaaggttagctggtcgacctggttagcaaactcccgggttaagcggtggtaagaagaaccggaggcaatcaccaaggggatcttggcggtgaccatccgggtgtaggttttagagaagagttggtggtcgtaaccgtgggcgtcgtttaaaaaggtgccgtccatgtcagtgacgatcattttaattttagtggccatgcgggtgcccccattcgttgtctagaggaacttcagcgtcatttaaatcctttaggtaggtggctaagcaggtggccgccgcgctaccctgggtgccggaacgggtggtgatgaccacccggaagaccagccgtcccatttgatcggtggttggcccggtgacgtcgggttctttaattaagccgtcgacctcctttagcaggcttgggccggcctttttaacgatcgcctccacctggtcgagcggggtcgtcggcgtgatttggatgtcgacgttggcggtcagattgtggcgggagaagttttgtaccatggtgatgttgcggttttgaatgtaggtcagagtcccgtctgcggagagaacctgggtggtccgtaacccaatggcggccacggttcccttggtggtgccaatttgaaccacgtcgccaacgtcaatctgttgttccaagaggatgaaaaaaccgttaaccacgtcggaaacaaacccctgggccccaagccccagggcaatggagaagattccggccccggccaacagagtgcccacgggaaccccgattaaagataagagggcgtagagtaagaaaaagtaacaggtgtagcgaaagatgttgagggttaaggcgtgaaaggtagccgcccggtgcgttccgcccagcacctggatgcgcctggtctggtgaaaggcggcgtcaatgattagttttccaacccagaggatggcgccaaagatgacaaaggcgaggagaatggacaagatccgatcacccagatttttgacgatcgcatcccaattaagggtggagaagtaatggctgatttggctggcctggttggtcagcgaggtggaggcaagtagttccataaaattgttcctttatccataaaaacgttattgttttctatcataacaacccagtggcacgccggcaaatcaatttgcggtcgatacctaataatgctatccttaagattaaataaaggaggtttcactatgactgttggacaacttgcgggcttaattgcggccctagcgctcgtcgtgttggtaatttttatcgcctggttcctcgtaaaggtggccggggcaattcgggatgccatcactagtgtcgagcaactcaccaaggatgttgataccctcagcggggaattaaacgaaatcctgaagaacagcaactcccttttggaggacatcaacaaaaaggcggttcaagtcgatccagccgttcaggcgattgctgacctgggacagagcgtttcagacgtcaaccaagcctcccgttcactggtggaaaacttagcgagccggcgtgaaaagcgccgcaacagcttcatgaagtccgcggcccaagcagcggcgataggggttgttagccgggtctttaagcgcaagaagaatcagtaggaggacgtcgaatggcaagaaagtttttaacggggctggcactgggaagtgtggccgccgtggctgcctataaggcactgagcgaagaaaagcgccaagcactgcgcgaacagttccaaggacggtttaaggacctgatggattacctgacggagtactccttgttagcgctggacgtcgttgacggggcggttggcgattaccaagaagctgctagcgacaagcttgataacctaaaggacaccttgaaggatcaggcaagcaaggttggtaaccacttcaccaacgacaacttcgacgcccaaactgaggagttgcgccaaaccttggcccaagcgcaccaagcacaagcggcgccagaagaagacatcgtaatcgaccaaactaaagagcaagcaaaagaaccggaaaagacagccggtgagccattgcatgaaccataaccaaaagaatagtaataaaagcccgtaccgggccaatcgaatgcgattgggctggtacgggcttttttgtgtttgcttggcttagccgacgacttgtagttccttgctggtgtgggtgaaggggaggcagccgtcttcggtaatgtggacgcagtcttcgatccgaacgccggccacgcccgggatgtaaatccccggttcaattgagaagcacatgccgggttctagttgcatgtcgtttccttccatgatggacggaaattcatgttcgctcatccccattccgtggccgaggcggtggatgaagtactcaccgtagccggcctgttcgatcacgtctctggcgaccttatccaattcagcggccgtcatccccggtttggcagcggcctgggcggttaactgggcctctaagcagacttggtaaatgtctttttgttgatcgttgagcgccccgacggccacggtccgggaggcgtcggagatgtagccatcgtaaatcgtcccgaggtcaaacaagaccagttggttattttcgatttggcgactactggtggcgccgtgcggttcggctgcgtgggggcccgcttggatcagggtgtcaaacgacatctgcatgatgccgtgcttttttaaggcgtactccaattcggcggccacggcctgttcggtttggccaaccttaactgcgtcgaacccgacctggaaggcaaagtcggcccacttgccggcttcgttgagcttttcgatttcatcggccgatttgatcaagcgcatccgttcgatggcgggggtcaggtcgaaatcaaagtgggcggccgggaattgttcttccagggcccgtaaccgcgtcaccgtcaaaaagcctagttcggcaccccacttggtagggttagcgatccgtttttgaacctggtcagcgatcattttaaacggtgcttcgtggtctaggtacccgtagactgggtagggccaaccagtgcccttaatggcttcgacttcgagggccggcccaaacaagaaggggtcctggtcagcaaagaccagcagggcgaggacccgttcaaccggatccgagccaaaaccggttaggtacttaatcgtcattgggtcgctcaaataggcgacgtctagttgttggtcggctagcagttgttgaaggtggtgcaacttttcgtaattcatcaaatcaatcctttccgtcttgtaacagcgattaagtcgattataacgcaaaattaccataagattgatccataaagttgccctttaaagggaactttgctatattatggattggattgaaaactctatgaaaacataatagatcaagaaggagagcatcatgcaaaaacagtcagtaaccatttacacggttgcacgtgaagcccgggtctcgatggccacggtttcgcgggttgtcaacgggaatcctaacgttaagccggaaacccgtaagaaagtcttagacgtcatcaaggaattgaattaccgcccgaacgcggtggcccggggcctggcctccaagaagaccaccacggtgggggttgtgattccggacgtgaccaacgactacttctccaagttagccctcgggattgacgacattgcttccatgtacaagtacaacatgattttgaccaactcggatgccgatgaccacaaggccttacaagtggtacgcagcatgatggccaagcaagttgacgggatcatcttcatgggccacgacatctccgaagaactgcggcaagaattctcttcctccacgattccggtggtcgtcgccggctctgccatcaacgatgaagatttgccaacggtgcggatcaactaccaagcagcaacgaaagaagctgttcaatacctgcttaaccacggtaacgacaaggttgccttggtgatcggctctaaggccagtacgatcaatgcccagatgcggattccggggtatgaagcggcccttaaagaggccggccagtccttagatgaagccttaatttttgaagctcacgattcctaccgggaaggttacgacctaaccgaaaaggtgctggaaagtggcgccaaggccgcctttgtctccgacgatgggattgccgccgggctgttaaacggcctgaccgaccacgggagtaaggtgccagccgatttcgaactgattaccgctaacgacactaagttaacggaaattactcggccgaagatgacttcggttacccaaccactttatgatattggtgccgtttcaatgcgcctgttgaccaagctgatgggtaacaaccaagctaccgatggtgaagatggcgatgacgagcaaaacgtaatcttgccacacgggtttgaagaacggcaaacgacccgctaatcactgggggtgatggcttgatcccaagagcggagtaccaacggcggcaccaagaacaagcggcggcccccttagaagctgacttagggccacgaatcgggcaccacttcttcttggccttgctaacggttttagcgaccctcaccctgttgatcaccattttgatcaatggaacggtgttaaatgagtcctttgctaaacaggaactaaccaattccagtttagcgacctccctacaaaatatgatcaaccaaagcgtgagccagtacggttactcgggaacggtggtaaccaccaagcaagccaaccagttaatcgagcaagtggtcgaagaggtttacgaggacaagacgattcaagtcgacctctcgagcattgaaagtagccttacgaaccaggctagcgagcaattagcttcgacgctgggaatttcggttagcctcgccaacaactcggcgattgccgccattgaaaatcagctaagccagcaggtcaattcccagttaaacacgagtcagctccaggaagcagccagcgccattaaaacttgcaaggtaatcaccaacttggtactactagtgtccttggtcgttttggccctgtgcctagtgaccgccactttcatgcgaacggtctcgtttccaattacaattggcgatgcaatggcctgggttagcctcttgtttagcggactattgctcttgccgcaactctggtcgggggcgatcaccgatgatcaaaccctggcgcccctagtttcacaggtggagactgacgttgtgaacaagggctggtccttagtggtgatcccggtggccatcttcttgctctgcctattggtgcgggtctggcggcggtttagcagatgggcttgaaaaaacgcccatgatttagtataatttgactgtttgttatcatttaaagaaaagaggagttagttcatgtcaggacattcaaaatggcataacatccaagggcgtaagaacgctcaggatgccaagcgtggtaaaattttccaaaagatttcacgtgacttgtaccaagccgctaaagcaggtgacccggatcccgacaacaaccctcaactccggttggtaatggataaggcgcgggcagctaacatgcctaagcaaaacatccaacgggccattgacaaggccactggtgctggtggggccaacttcgaagaaatcacttacgaaggttacggtcctggtggggtagccgtaatggtcttctgcctgaccgacaacaagaaccggacggccgccgctatccggtccgccttcactcactccggtggttccttaggggccacgggttccgtttcctacatgttcaaccggcaagggttaattgaaatccttcgtgacggcttggacaaggacgaagacgacatgttgatggacgcacttgacgctggggctgacgacatgcaagccactgacgacaagttccaaatcttcacggatccttccgccatgacttccgttcgtgacgccttacaagaacaaggctacgaactggaaacggccgaagtaaccatgatcccagaaaacaagaccaaggttcctgccgacaaggttggtcaataccaacacttgatcgatgaattggaagacaacgatgacgtggctgacgtttacgaagcagccttcgttgaagatgccgaccagggcgaataagttaagtaaagaggttgagagaaactcgtgtttctctcaacctcttttcgttttggtaacagctaggtaacgaacggtgtcaatcgttacaaatgatatattaccgtaaatattcataaatctatcatacttataacaatctattgtataccttctgtaatggtctggtaatttttttcgtttatattaagggggtccttgtgaaaggataaataatataaggatgtgaaggattatcaaaacgaaactgatgctcaagtgcacggtggccttaggatttggaaccattggccttgcagccgccggagcaacggcccatgcagacacgatcacgattcaaaagggtgacacggtgtggggctattcacagcgctaccacgtgacgatgggtgacattgttaaagcaaataacttaaagaacccgaacttaattattgccggaaagacgatttatattccaacgagtgggggctccagtgcttcaagcacggcggccacggccagttcaacggcgacgagcaccgctactagcgccactagtgctaactcagcgccaagctcgagtgtgacgagttcgagtgccagtgaagtggccacgaacacgtccgctacgagtgcggtaagcagcgccgtagttagtgctaattcggctgctgattctagcgctactagtaccacgagcgcaaccaacgttgttagtgctagttccgccgttgctagtgccgactctgcagtaagtgcatctagcgattcagccacgagtgcggtggcatcttctgccaccacctccagtgctgctagctccgcttccgccacgagtacggccaacaccacgatggtgacggtctcagccactagtgcgtcctcagcaagctcatcaacggcttcatcaacgaccaccacttccacgactaccacaagcacgtcgggagtggctacttacagcgccgcccaagcggtggcccgtgccgaatccgtaatcggtacaccatacgtatacggtggaaataccacgagcggctttgactgctccgggctagttcaatgggcatatggcctgagttctacttaccggacgacttaccaacaacaagccttgggaacccaccattacgacgttgaaaacgcaccggctggggcgatcgtcttctttggctccgatagtgcaccgtaccacgacgggatttcgctcgggaacgggacctttatccaagccccagatactggtcaaacggttaagatcacgagcatgtccgcttacacgccaagctactacgtggttatcaactaataagggtgtttcattattttccccaaaggagctgcgatagggatgtcgcagctttttttatttataaaaccaggatcgttaagaaccttataaacaattaaccccgctttagcgtaaaaatcctcaaagtttattcatgtacgggtagaatatctgggaggcgggcagtgctaatgatttttacacggcagctatcgttagcatgtccaaaagttggcataacttttggtatgctagctttgatccggctgggtttatcaccgtcgacaaacccccggtagccctctggtttatggttatctgtgttaaaatctttggccttcacggttggagtatcgttttatcctcggtcctgtttggaatcgggtcggtctatttgatttacaagatggttaagccaacttttggtcccttaaccgcacggatagccgccttctttatgacaatcaccccgatcgtggtcgccgactcccgaactaacaacatggatgccacgctggtctttttcttactgttagccggttgggttttacaaagggcggttcgaaagcgacggggatggctggtattggtatcctttgccctagtgggggtcgcttttaacatcaagatgttacaggcatacatggttttgccggccatgtatctttactactcggttgctagtcggcagaattggaaaagggtacttactcagaccgtgttggccaccttggctttagccgtggttagcctcagttggcccctggcggtcgattcgacaagtaaaagtacgcacccttacattgggagttcttcaaccaactcggttttgaacctagcgttcggttataacgggacgcaacggttatttgggcaaaccactggaaccggggggactttctctgggatggggactaaagcgagtggtaaaactaagaccggggccccaacgggtggtactaagcaggggggaatgaaaaagccagctggcggagccccaactgggcaggctaagccaaccagcgggatgaagaaggggactacaaacggggggaagccttccggcaagtcgttaagtagtatgccaagaaccaccaagggacgcccaactggtatgaaggggggcgctggccaaggtggcaatggtatcttcaacgttgggaccgctggggtgacccgcctattccagacggcattgagacggcaaattagctggttcttgccattggccctttttggaatggtagcggcttacttggctgcgtacgatcgtaagaagaagtggtggcagactaaccggaagcaacaagatgttctttattgggcggggtggctaatccccgttggggccttctttagcgttgctaacttctttcatccttattacaccatcatgctagcgcctccgttggcggtattagcggccctggccattacaagtgggctaaaaaaggccacgtcgaaaagggatgataagagggcgcgctggttgcgttaccttttattcatgggcttagggaccaccgcttgccttcagtcctattatgtttgggcttactatccgtggttaagtttggttattttgattttgaccgcggttgcgttggtcatgatgaccttgatcccagctaaggaacgcctctttttaaccttaggggtaggtttcctctgtttggctccgggtttttgggccctgaccccaacgatctctggtgaatccgcggccgttccgaccaccggacttggcactggtacggtgaatacccaactgatcaaataccttaaacaacataatgacaagtcaacaacctacctgtttgccaccaccgattccaatacggccgccccgtacatcatcaagaccggtcaggccgtgatgacgatcgggggctataacgggaccgataacgcaatttccctgaagaaatttaagcaattggtcaaggacgggaaggttaaatacttctacatttcgagtcacaccaataacaacgcacttgttaagtgggtcaaaaaatacggtaccaaggtgagtgccagtgcatatggtggcacaagtagccaaaccaaaggcgtgggtgccatgggaagtaccaatgcgaccctttaccgtttatcagcatccaaataaggcctggtcaaagggaccgtacaactaagtaggattaaataccttacgttctctaactaaataatcggaaatgccaagggctgagaggaacccaattgttccctcggcctttttagcgccctagattttttgccattaatttcgtcactttttccgtgtcctccgtacttagtaaacaaggagggattaacgtggaaagttggttacgaaaagagatggccaccatgatcggtgagcgggtggccgatgcctatattttgccccaccagggtcgctaccggttagcctcctttgaacgggggcaggtaaaggaacggcgttcgttgacgctggccgggggacaacagctaatcgcttattttaagtaccgcgccaatatggcggtcactgagcaccggcggccacagtcaggtgggatcagttggcccagtaaggaaggggtggtcaacctgcgcttatcaaccgtaggtgattttacagggcaagaatcgttagtcatccgcttcatctacccggttagcaccgactatcagctcctggttcccactcaatggcagaacttacaccggtttgctcgccagcgggggctggtcttatttgccggtcccctaggatcggggaagacgaccaccatgtaccgtttagcgcgcgaagtcaaaaaagagcaggtggtgatgacgatcgaggacccggttgaaatcgaagagccctggtttatccagacccaggtcaacgaactggcggggttaagttatcaagaactgctacgggtgagtctgcgccaccgtccccacattttgatcattggcgaggtgcgcgacccaatgacggcgaagatggcggtgcgggcgggtttggccgggcagctagttttagcaacggtccatgcccgtagcgcgggtggggtttatactcgcctacgccaactgggggtgagcgaactggagttagcccaagcggtaactggggcttgttaccaacgcctggttcccctagctagcgaaggggcggcggtgttatttgactttgccagtccggggcaggaaaaggaaacgaggaaggtgaccccactgtgggtgaaacacttaggggaggcggtagcaaatgggaagattacgcaggaaacggcggaagaattcgcggccggttaaaatgaaacaggggcaaatggcggactggctcttattcttgggggatggtattgaccgggggattagcctgcgccggctggtaaacatgtcacaacggctctacccaaagtggcaggggatgtttgatgaaattgaccaggcaatgctcatgggcaagccctttgccgaggcgctgggcccttggctttcggtcgatacttactaccaactacgcttggcagaacgccatggtaagttggcggaaacgattcaccaggtgggcaagttcatggcactgcaagcaaagcaacgggcccgtttacgggcggtcatgcagtacccggtgattttactggtctttttagttctagtgatcgtaatggtgattcactttgtcctccccgaggtcgctagttggggcagcggggcgaggctggccattcccccgttggttaccacaattggtttaacgtgtgcgggggcactactcgcttcagtggtcctgttgggcgtccggtggatgacaatggacccagagcagcgcgtccgcttcttgtgcaccctgccggtaattgggcaacccaccaagtactactggtcctactacctagtggccaacgtagccgtgatggtcgaaaacgggatgtccctacaagaaattagccggctggttggtcaatttgatcagcgctcgatgctttatttagttggtcaaaagatcagtggagccctagcgcgaggacgaccactagaagccgtcgtttcacatctcgattacttaccaagggagctgccttcatttttaaaccggggcctaacccaacgggaattaggggaggaattagcagccgtggcccggttaaattatcagcgcttgtcgtcacggtcgtcgcaattgttggagttaacccagccgctgattctggtgatgatagctgctgtggttgtggtgatgtatttaagtatcctgatgccaatctatcaatcattacaggtggtggaataatgttaaagaaattgaaaaaacgggtggccaagggctttaccctggtggaaatgacgattgtcttgttcattattagcttgttaatcttgatcatcgtgcccaacctaggggcgcaaagaaaacacgccactttggttaaccaagaggccttagtcaacatgattcaaaaccaggttgagctataccatgacgatacgggtgacgtcccgaccgatttgtcccaactagaaaagggtgattacctaacggctaagcaggttcgccaggctagccgcgaaaatatcacgctccaaaatggtcaggccgttgttcaatagccaacggcgcgcctttacgatggtggaagtcgtgatcgtattggccatcagtgccctagtgatcgtgaccaccaccattccttaccaaaaaaggaacgccgagctgagtgaggaacagttttggcgggacgttaagcagcgctggcaagaggcccaaacccgggcccgggtagagggaaaggcgacctttatctatttgacgagccgatcgaagcgagaaattagatttgagtatcacactgatagtgggaagaaggtaacggaggaggtactacttcccaaacaacttcacattgcctctaacgaagatatggtcaagatttacaaaaacggctacgttagtccgcggacctggtcctttgtttccaagttaacgatgaccaactacgacatgaaaattcagatgggttgggggggatactatgttcaaaagactgcggtgtggggctttcctgctggctgagcaactggtggccctaacgattttgggcgtggtggtcgccagcttggtggtggtaacggagcaagtcggggtcaagcgtcgtcaattagaacaaaacttagtcgccagtcgcttagttaaggaggcgaccgatcaaattgcgctaggaaaagatcaggtggcactgagtcggcagggggtccgagcgcaggcaacgaggcagggggccagggcctttatcggtaacaagaccctagtcgaaatcaagggggaatgagcatgcgacagcgggcctttacaatggccgaagcaatcgtagccttagcattggtggtgttggtggtgaacctgtttggcctggtaatgggtgggtatggccgtttaaccaaggtcgacgcttcagaaccaaccaattggtacttgtttatcagcgagctagaatccaaggatcatcagtttcagctagtggaggtcgccaaaaacggggttagtgtatatagcaagacaacgaacaaaacgtaccgtctctctcggcaggcatccggtcagtatatctatttatcaaccgaaggaaggggaggctttttgccgatctttgaaggtcaagccactaaattgacctgggagcaagtcgaccaaagacgggtcaggtttacttataaggggggacgacatgaacaaacggcggtggtatgctttgcggcaccgggcgactagtatcctattggcgctcctggcaatggaatgtgtgacggggattttagttaccgtcagcaattacatgaccaatcaggaacggattacgaggcagttaattcgcgagcaacaagaggcggcgcgacaaaatttacggcaggcaaattcacaagcgacaagcaagggaaaagcaagtgaaggaggcacggtaaattaggaaagcaagggcttccttgaatttgtgaacgaaactaggtaaaattggtttatctaggattttgaagggagtgaccacgactggaacgtttaagtccagaaacgttattcacgccgtttgatcaagcaacgcaactgcttcaaacggccttagcaagctcttacctcgatgccttcctcgaaaacgccgagaacctagcggatgggggaacagtacgggttgaagacggggtgccggacgccgaaacgactgagaagttaacgaagctctaccagtcaattgacctgagccaggccgatcgggaaaccaagcgacggctattgcaactagggatgttgaaggtgacccaaaaggacgccattcaagcgacccatcagatgacccccgactcaatcgggatgctgatggcctcgttgatcgagcgggtgaccaaaattgaccacccgtaccgcatcctggatccggtggtggggacggctaacctgctgaccacggtgatgaatcatctccaatcggttaccgaccaaccaatcgagggttacggagttgataacgatgaatcaatgctcagcgtggcggccgtttcgacccaactccaggaccttcccgttcagttgtaccaccaggatgcaattcgggacctcgatgttccccaagtggacctcgtggtggcagatttaccggtgggctactacccgctggatgacaacactaagcggtaccgcacccgggccaaggaaggtcattcctatgttcaccacctcttgattgagcaggcgatgaattacttgttgccgggtggctttggggtcttcttggttcccaagacactgtttcaaagcaaggaaacggctgggttggtggagtggatccaatcagttgcgtacatgcaagggttgattaacctgccagaggaactgtttgctaactcaacggtagccaagtcgctcctcttgttgcaacgtcagggggggactagtcaccaagcgggcaaggtcttattaggctcattcccgtcggtcaagaatcgtcctgaatttattgcctttatccgtgaaattgataactgggtggcccaatacttagcccccgccaaataaaggagaatttgtaatgtcaaaaacgattgctgttaacgccggtagctcaactgttaagttcaagttgttcgacatgccaagtgaagaagttgttgcagaaggaaacatcgaacggattgggatggacatgggtcacgccaagattaagtacggcgatggccaagtcagcgaagaagaaaagccgttcccaaaccacgggacggcggtttcctatctgttggaccaactgatcaacttggggattgttaaggaataccacgaaattactgccgttgggcaccggatcgttgccgggggagaattcttcaaggattccgtggtcattgatgatgacgtaatgcaaaagattgatgaactggctgaatacgcaccgctgcacaacccggccgaacttcaagggatcaaggccttcaagcgggtgctgccggacgcctttgcagtggcggtctttgacacttccttccactctaacatgcctgaaatgaacgcactctactccgttccttacgaatggtacgaaaaatacggtgctcgtaagtacggagcccacggaacgagccaccgttacgtcgcttcccgggctgccgaaatgcttggtaagccactggaagacttgaagctgatcacttgccacattggtgccggcgcttcgattacggccatcaagaacggtaagtcctttgacacttcaatgggattctccccgctagcgggggtaacgatggctacccgttcaggggacgtggacccgtccttagttgcctttgttcaatctaagttggggatttccagcgaagaaatgatcgagcttttgaaccacaagtctggtttgctgggtctttctgaactgtccgccgacatgcgtgacgtgcaagcggccgctgaacacggtaacaagcaatgtgaactggcgcttgaaatttacgaaaaccgggttctcaagtacattggttcctacttagctgagcttggcggtgctgacgcaatcgtctttacggccggggtcggtgaaaacgacaaggaattccgccaagcaattggggacaagttagcttactttggggtcaaggttgacccagaaaagaacgacgtccgcggtgaagaacgcgatgtttctgccgacgacgctaagatcaaggttctcttgatcccaaccaatgaagaattgatgatcgttcacgatatcgaacgacttcgcaagcaagcctaagggtttgaagaagcggggagcctgcgggtttcccgctttttgtttaggaggaaataatggagtatgtaatctcagacacccacttttttcacgagcaactattgggagtcgatcagtttgcgcctcgtccttaccagaccgttgaagaaatggatcaagtgatggtggaggcttggaacgcccgggtaaaggaaaatgatacggtttaccaccttggagatatcgcggttaactaccaaaaccaccaaccagaacgggttgccaatgagcaaattgcgaccctccttggtcaattaaacggtcacctagtgttaattaaggggaatcatgatcggcgtagcctgtttaaatacttagcggctcacaacccaagggttggcaagcgggttaagtatgagtttcatgacgttggtaagttaattaagtacgaccatcaccagctctacttgacccactacccaatgatgatgggaattgcgcccaagatcattaacttacacggccacattcaccattacatggtcccaacgacaactaatttaaacgtcggcgttgacgccccagagctcgactacttaacgccccgtcccccctttgggactcccttgtcgttgccagaggtaatggagatgatggccaaaaaggttgccgtggtcaatcaatctaatggcgtggtatgataacaaaatgaaaggatgtgacctaggtgaaccgggcacggattcaagaattaattgagcaacggatgagccaacgaaaggggctttaccaggtgacgttacaagacgccacccatttcaccctcaatggccacccctacctactgaagaaaaactaccgggaggccttcaacggcgatagcttagccgaccgttttagccccctgttgacgaagtacgattacattgttggtgactgggggtatgaccagttgcgcttgcggggcttttacgcgaaacccgggcaaggggaggaagagcagggcgtaggatgcattaatgattacctgatggaagagtgtaactttgggtgtccttactttatcatccaaaacctggaggttgctcaccccaagcgaccacggaaaccccggacgcggcggcgtggccgagcggagatcagtgaagagaaaaagccccttaaagaaccggcgctaagcaagcgacggcaccaagaggtacggcgtgtgaagggaaagggtaaccgaacgaagctagtggtacggacgcgaaaggatgactaatgagcaagcaggagagttacgaaggctacttgattgatttggatgggaccatgtaccggggcaaggagaagatcccggcggcccctagttttataaggcgcctgcacgcggctaacaaacgggtgctctttgtcaccaataattcgacgcggtctcctgagcaggtggcggccaatctagtcactaaccaccaaattccggcccagccggcggagatatacacaacggccttggcgacggccgattatttggctaagcgggctggagaccgccgccgggtttatatgatcggtgaacaagggctaaaggatgcgttggaaagcaggggctttgaattgacggaccagcgccctgattttgtggtggtcggcttagataccgaggtaacctatcgcaagctggaggttgccgttttggcaattttagcgggggctaccttcattggtactaacgccgacagtaaccttcctaatgagcgggggctgactcccggagcgggttcgttagtcaagttggtcgagtacgcaacccaaacgaaacccatcatgattggtaaaccagaggccatcatcatggagatggccttacaacgggtcgggttaactaaggaacaagtggtgatggttggtgataattaccacaccgacattgaagctgggatcaacgtgggcatggatacgctcctggtttatacgggagtgtcgactaaagagcaggtggcaagagaggaggtcccaccaacccatgtggtggattcattagatgactggatggtggaataatttaattaaccaggggcgcacccttctaatcacgttagcaattatgctagcgtgcttgggtggcgccctttttttggtaacgaacgcttcatatttcttagtagatgggcgtttgatgggagttagtcagcgaattgtcgagcacgattacttgcgaattctggggtatttacagcttccctggtcaggggagacgatgcggcttgattatttgcccacggatgcaaaggtgctgcgtcactttaaagacgtccgccaccttttcttattgggtgagtctataacggttggcgcgagtttagtgagctggtgggggctatggtgggctaagcagcgctatcaactatggcggttgcgtgggtggttgcaatggctactagttggttttttggtggcggtaattttaattggattaaattttgaaccagtcttcttgtggtttcattaccacgccttttcaaaccaggattggctttttgatccaaaaaaagagcccctcatcaacctgtggccaaccagcttttttatgacattagccattagctgggggcttttggtcgagggactcatttacttaatctatcggtgggtgaaaaaagagttacaccgcttcgtctttttggaaacgggccttgaagaaaccaacgatggccgggattaacgtgacaacgatgattgctaggataattaatgagaaatgggccttaacgaaggggaggttaccaaagaagtaacccgcaccacaacaaattacgacccatgaaatacaaccgatgacgctgtaacgaataaaactgtggtaggcaaagccagaaccagcagcggcgaagggagcaaaggtccggatgattggcatgtaacgagccaagataatggctggcgcaccatgcttttcgaagaactgttccgctttggcgaggctatctttatcaattaaacgtccgaaaagggagtgattggatagttccttcccaattttatgaccaatcatgaagttacatgagtcacccagcaggcaagctaagaggaagatggcgacaaagatccaaatgttaaggttgtagttagcattagcagctaaggccgctgcggcaaagaggagggaatccccaggtaagaaggggaggatcactgcgccagtttccacaaagatgatggcaaacaggattaggtaggtccagtccccaaagttgttaacaatttggatcagatgtacgtcaatgtgcaaaatgaaatcaattaaggtcgacataaatggctcctttaaaaatatggttaattaccggtaaattgtatcaagacgtcatgtaattgtgaaggaaagtccctatttaggatctaaatgaacgttaaaaggatgattacgttgaacaaaccatcattgttcgaattattttttgatctaggatggaacttcggtataacgttcgtgttttgtaaaaatccaaaatatatactaaattctattgacactttgcggtattgtctgtatagttatataccgttgtcacgacagatatcacttcggatgaagatgagttggaaaaagttgttgacagcggatggtaactctgttatattataagagttgctaatccagcaacgaacgaaaagttgtcaaaaagttaaataaaaaacttcttgacaatgaaaattgttcatgatataattaataagccggctggctaagttggtcggcggtagacctttgaaaactgaataatgtttcgacgaatcaaatgtgtagggtccttgatcttaatgatcgaggcaaaaacatttgcgaagtcaattcgcttaatttattaaaaagagctattcaagcttcttattttatatgagagtttgatcctggctcaggatgaacgccggcggtgtgcctaatacatgcaagtcgaacgcgttggcccaattgattgatggtgcttgcacctgattgattttggtcgccaacgagtggcggacgggtgagtaacacgtaggtaacctgcccagaagcgggggacaacatttggaaacagatgctaataccgcataacagcgttgttcgcatgaacaacgcttaaaagatggcttctcgctatcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctcctttctaaggaattaatcggaaacctacacattgtcgaaacagtgttcagttttgaggggtttacctctcagcttgtactttgaaaactaaataatatcaatttctaataaaatcaagaaaaccgagaacaccgcgttatttgagtttttaacgaattataatcgcatactcaactaacttgactgatctacgatcagtaaggttaagttatgaagggcgcatggtgaatgccttggtactaggagccgatgaaggacgggactaacaccgatatgcttcggggagcggtaagtacgctttgatccggagatttccgaatggggaaacccaatcatcttagtcgatgattacttgagcagtgaattcatagctgccaagaggtagacgcagtgaactgaaacatcttagtagctgcaggaagagaaagaaaattcgattccctgagtagcggcgagcgaaacgggaagagcccaaaccactgagcttgctcagtggggttgtaggactgaactttggagttaccaaagaatcaggtagtcgaagtggctgggaagccacaccagagatggtgatagtccagtagacgaaacttggttctctccgttcaggatcctgagtacggcgggacacgtgaaaccccgtcggaatccgcgaggaccatctcgcaaggctaaatactccctagtgaccgatagtgaaccagtaccgtgagggaaaggtgaaaagcaccccgggaggggagtgaaatagttcctgaaaccatgtgcctacaagctgtcggagcccgttaatgggtgacggcgtgcctcttgcagaatgaaccggcgagtcatgattacgtgcaaggttaaggtggaaaaaccggagccgcagcgaaagcgagtctgaaatgggcgtatgaagtacgtagttatgtacccgaaaccaggtgacctacccatgtccagggtgaaggtgcggtaaaacgcactggaggcccgaacccgtgtctgttgaaaaaggctgggatgaggtgtgggtagcggtgaaattccaaacgaacttggagatagctggttctctccgaaatctctttagggggagcctcggaatcgagaatcttggaggtagagcactgtttggacgaggggcccgtcatgggttaccgacttcagataaactccgaatgccaatgatttatgtccgggagtcagacgatgagtgataagatccaccgtcgaaaggggaacagcccagatcaccagttaaggtccctaaatatatgctaagtggaaaaggatgtggagttgcatagacaactaggatgttggctcagaagcagccatcatttaaagagtgcgtaatagctcactagtcgagtgattctgcgccgaaaatgtaccggggctaagcatattaccgaaactgtggatgtgtccttttggacacgtgataggagagcgttctaagggcgacgaagttagaccgtgaggactagtggagcgcttagaagtgagaatgccggtatgagtagcgaaagacaggtgagaatcctgtccaccgaatgactaaggtttcctggggaaggctcgtcctcccagggtaagtcgggacctaaggcgaggccgagaggcgtagtcgatggataacaggttgagattcctgtaccagttaaatgcgtttgaatgatggagggacgcaggaggctaagcaaaccagacgattggaagtgtctggccaagcagtaagtcaggtttagagttaaatgctttaagccgggttgacaagctgtgatggggagcgaaattaaagtagcgaagttgccgatgtcacactgccgagaaaagcttctagtgagtatttaactgcccgtaccgcaaaccgacacaggtagtcgaggagagaatcctaaggtgagcgagtgaactctcgttaaggaactcggcaaaatgaccccgtaacttcgggagaaggggtgctggtcgcaagaccagccgcagtgaaaaggcccaggcgactgtttatcaaaaacacaggtttctgcaaaatcgtaagatgaagtataggggctgacgcctgcccggtgctggaaggttaaaaggaagagttagcttcggcgaagccctgaattgaagccccagtaaacggcggccgtaactataacggtcctaaggtagcgaaattccttgtcgggtaagttccgacccgcacgaaaggcgtaacgatctgggcactgtctcaacgagagactcggtgaaattgaattgcctgtgaagatgcaggctacccgcgacaggacggaaagaccccatggagctttactgtagcttgacattgagtgtttgtactacttgtacaggataggtaggagccgtagaaaccgggacgctagtttcggtggaggcgttggtgggatactacccttgtattatgaccactctaacccgcaccactgatcgtggtgggagacagtgtcaggtgggcagtttgactggggcggtcgcctcccaaaaggtaacggaggcgcccaaaggttcgctcagaatggttggaaatcattcgcagagtgtaaaggcacaagcgagcttgactgcgagacagacaggtcgaacagggacgaaagtcgggcttagtgatccggtggttccgcatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcatcgctgggtagctatgtatggatgagataaacgctgaaagcatctaagtgtgaaactcgcctcaagatgagatttcccattcctttggaagtaagaccccacagagatgatgtggtagataggatggaagtggaagtgcggcgacgcatggagcggaccattactaatcggtcgaggacttaaccaagtcaggtgtgaggattcttgatgagaaaagatattgtttagttttgaaagcacaagctttcaaagtgtggtgatgatggcctgaaggatacacctgttcccatgccgaacacagaagttaagcttcagcacgccaaaagtagttgggggatcgccccctgcgaggataggacgttgccacgctgttatggaggattagctcagttgggagagcgtctgccttacaagcagagggtcacaggttcgagccctgtatcctccatttgagccgttagctcagttggtagagcatctgacttttaatcagagggtcgacggttcgagcccgtcacggctcattgccacttgtgggttttatacgccgacttagctcagttggcagagcacctgtcttgtaaacagggggtcggaggttcgagccctctagtcggcatcaaacttaatattatgcggaagtagttcagtggtagaacatcaccttgccatggtgggggtcgcgggttcgaatcccgtcttccgctttgccaattctatataatgccggggtggcggaattggcagacgcacaggacttaaaatcctgcggtcagtgatgaccgtaccggttcgatcccggtcctcggcaccatacgcacccatagcgcaattggatagagtgtctgactacgaatcagaaggttgaaggttcgactccttctgggtgcatttaacgggaaatagctcagcttggtagagcacctggtttgggaccagggggtcgcaggttcgaatcctgttttcccgatttacaatttaatagtaattgtagtatctttttcgcggtgtagctcagctggctagagcgtccggttcatacccgggaggtcgagggttcgatcccccccgccgcgatttgggtggttgtattggacctttagctcagttggttagagcaagcggctcataaccgcccggtcgtaggttcgagtcctacaaggtccatcaagcccatcgcttgatggtgctgttgtacactttcagctttatggaggattacccaagtggctgaagggggcggtcttgaaaaccgctaggtcgttagcgcggcgcaagagttcgaatctcttatcctccttatattatcgcggggtagagcagtctggtagctcgtcgggctcataacccggaggtcgttggttcaaatccagcccccgcaatttctttggtccgttggtctagctggttaggacgcatccctgtcacggatgagatcacgagttcgagtctcgtacggaccgttttaatatatactggctcagtagctcagttggtagagcaatggattgaagctccatgtgtcggcggttcgattccgtcctgcgccatgttgcgggtatagtttagtggtaaaaccacagccttccaagctgttgtcgcgagttcgattctcgttacccgctttttagatgggtctatagctcagctggttagagcgcacgcctgataagcgtgaggtcggtggttcgagtccacttagacccatttggagaattactcaagtggctgaagaggcgcccctgctaagggcgtaggtcgggaaaccggcgcgagagttcgaatctctcattctccgtattgacaccatgggtgttgcccgtggtgtttttttacggccacagcttctctttaaaggtggccggtaagttagcaaattagtccttgcaattatgataataacttgctatactatatactgttgtcagttatgatgacccgttggtcaagtggttaagacaccaccctttcacggtggtatcatgggttcgaatcccgtacgggtcacttttattatcgcggggtagagcagtctggtagctcgtcgggctcataacccggaggccgttggttcaaatccagcccccgcaatttctttggtccgttggtctagctggttaggacgcatccctgtcacggatgagatcacgagttcgagtctcgtacggaccgtctatagaagaaaaaggatcggttaaacaccgatccttttttgtagtttaaaaaacgaaataatcttggtggtagaaggtgttttgcggacccggggcttggaattcctttaggacccttgctggtacactttcagtccaattgctaaggtcgccagccttatcccacgtggttaacatcacaatggctcccgttcgatcttgattacgtaacaacattcctccgttaaaaccgggctgatccgtcaggtcaaccagaagttgacgagcatgctttaaaagtactttttcgggatcagcatctaagtgataagattccaggtgaatgaagggaccaaagttggttaggagaccgttttgttgaagggttgtaaaactaatcggggtagagaagatgggcttctcaccggaaagatcaaagagggtgcaccgagtttggtcagcggcgtccatcgtcataacaaggtgacggctggggtacttagctaagaatggttccaacacccctttggaaccagatgtatatgagatttgatttagcatgggcaattctcctttcgaggtctattctactcggtttttttaacatggggcgaatttacaattgaaatgcaacacaaagtaaaaaaataaacccataccgggtagaatatgtttaacgaccaaattaaacaattcgaggtatccggtatgagctataaacatcttactataaaagaacgtgaaatacttatgtttttacgagctaaggggttatctatccgggctgtcgcgttacggctggggcgaaatccaagcactatttcacgggagttaaaacgttgtgcaggtaattattccccaagcaaagcagataatgactatcatcaaaagcggcagaattgtcacaagaagcggctattagacagccatccacaattacgccgtcaaattgttcattacatcttagatctgcactggtcaccagagcagattaccgctcgctttaataaggaacatcaatggtgtgttagctacaacacaatttaccgtcatatctatcaacacaatttaggtgaaaagtactcctcacgtggtgataccggtattcagcgccatctcagacataaacatcggacccggcattcaaagaatactagacgacatcgagaagtacagaccgactatatctcgatccatgagcgccctggttttatcaaccagcgtcaacgtataggtgactgggaaattgatactgtgattggtcgaacgggtcactccatccttttaacggttgtcgatcggcttagtcggcttacgcttatcaaaaaggttatgcaaaaggactcgcaggagataaataaaggcttagttgaactgttaggggccattcctaaagaatttgttcattctattacaccagatcatgggaccgaatttcttcatcttgatgaaatcagcgaaaggttaggtattactgtctattggcccgatccatattcgcctgaacagcgtggaacaaatgagaatacaaatggattaatccgggaatattttcccaagcgaacagatattgataattatacagaacaggacgttgaacactgccaaaagcagttaaatcaacgtcctcgcaaagtgttaaactatgaaaccccatatgaagtattttttgacaaaccgttgcacttagtttgacaattcgccggaacgaagatgagcctattttcttttaccagggtcggtagttagtaattgggatgatcggttgataataagcgggtaccatgttctaaaggaaggggttaccagagtgagaaaacggaatggttgacatagcgttatttgactatgaatgggagggcggtaaattacctaattcacttacaaaaaattatgaaaacgtctttcattatttgctagtggaggttataatagttacaaaacgataagagtaggaaagtagaaatgaatggaggcatctcagatggttacactttacacgtctccgagttgcacctcttgccgtaaggcccgggggtggctacgggatcaccagattccctttactgaacggaacatttttgccgatccgttgacaatggctgaaattaaaaatattctccggatgaccgaaaacgggactgaagatatcatttcgaaacggtcaaaggcctaccagagcctcaagatcgacgttgacgacctaccaatgacggaactttacgaattgattcgcaagacccctagtttgttacggcgtccgatcatcattgatgacaagcggcttcaaattgggtataacgaggatgaaattcgtcgtttcctaccacgggaagtccgggcccttgagttagcggaagcgcaacggcgggcagatttggttgaataatgaacggggatggcaattggttggccatcctcttttgttatgggctctccctttacttttcgtcaggatccgttaaaattactaagtaatgaataagcaaaaccaatctgtgaaattgggagtgagggggcgcaaaatgaaagttaaaagaatcaatgattacacgctccaagtgatgctccaaaaggatgagttgaccgagcggggcattggtatgatggatttgatggggaaccaacagcaaatggaagactttttccagaccgtgttagacgaggtagaccctcagcatcaattttcgatggatcaaacggtgctgtttcaggtgatgccaactaacgacggaatccagttaacgattactaagcacgatggcgacgttaccgaccaagacgtccaagaacaagccgctgaaaatatctcccggttcttacaaaatgaactacgggggcacgatttcgataagaatgaccagcgaagccacggggctgatgcgagtgaacaaactcacgatgatgccgatgagattgccgcggccttaaatgaccctgacgttaaaaaatatacccgggtggtgaagtttgattcctttgaagacttcgtcgcccttgccaaggtgattgataccagtaacatggcggcggacttataccaagaaggccaccattacattttggtggtgaccttctttgaaaacggcgaactttcgccggaaagtgtaaaggatcgcttagccgtcatttacgaatacgcttcgccaagtaaattggaagccatggtagttgctgaacacggccaccgggtgatggagcacgccgcctttgaattggcacgccactacttcagttaatttcgtgacaagcaaaaatccctccgtacttactgagtaaggagggatttttatgttagtggctaaaaacgaacggggacaactggtgcgggctagcgatgcccaacggacgcgagggtaccgttgcccagaatgtgacgccccactcgtcttacgacagggcagccgggtgccgcattttgctcaccggcctaaacagggttgtcagttggcacaaggggagagtgagctgcacttgctagggaaagagaccttgtggtggtgggccaagcaacggggatggaatccccaactagaggttccgtttgaccagatcgagcaacgagcggacgttttagtgaccatccagaatcacccggttgccttggaatttcagtgtagccccctgagcgcacgtcggctagctgaacggacccaaggttatcagcaagtaggagtggcggttcgttggctactgggtccaacttaccaaaagcggctcctccaccgtgaaatccaagcgcgttttacccaactagttaataaccggcccagtttaaccttctgggagccccaccgagcacagttagactacctacagccaatttatcagggccaggttgggaatggtcgttggtgggcgcaggtgggtgttgagacggtcgatctacaccgccacgcctcgctaagggatgggttagttcgtcaagcctaccaagcggggcaccaagtagctgcttgtcccttagttgctcacgggcgtcgagaatggtggcccttaacctttgaacgcccggtacggtggcgcctcatgattttgctggccttagagcagttaccgctaggaaaaagttggcccccactggggtggcaggcttggttagcgacacagacgaagtggttgcccttgccggcccttaccccagtccaacgtcaggcactgcgaatgcaccacctaaacgagttaaccgcggatcttcttcaagcggggatcattaccatccgcggagaagagtaccgttacgttaggctcccccaatggtttgacgactttgatcaaaagctggccttcgttcgccaacaagagggaatctagaaaaaggagtggccaataaactacttagtcatacgacatgtagttagtggccacgtttgctgtctaacattcggatatgaggcaaaacaaaaacgaccttatccaaaaatgaatagggtcgcgatggtggtttgcatgaataaaaccctcaaatatctattaagtcccatactgagtaccattaccggtacgcggactcgaggtcccttatggaggtctaatttcttcactcttttaacataccacgattacccgatctttaaatcgtttttaagcaggacgggttaggttaggcttatttttgacaaatgcctctcgatcgccattaacttaataagttctaaagttagggtgcccctgccgagtgcggcgaaagaagcgttggtgggaatgattgaatttggtgggcgagaccgcctcgaggaaggttgcgtagtcaaaatcgtgaactaaggtgtcgtaatcgggatggttactgtcgtaaatgacggcggtggttgattcggcgacccccagttcattagcaatccgctggtcgtctttaaaggcttgttgactgagttcaccctgtcggtcttccataaacatggctaggtcgagtccgttgtctttagcgacctggtaggcgaggtcagcgctgtagttttgtccctcgtcaattaatgccttttggagccccaataagaattggcgtccccgcttgcgtccctgaaacaaagcggccttatagtcgagggtaacctggtagagggtggcagaaacccgttggcggttggccaaggtgggggcaacgttatatagacgtagggtctgttcgatggtgtgcatattgacgagcggaatgaagttaaaggttaaatcgaggtcgggtagttggtggtcagctcgcaacaggtcttgttcgcagttaaagcaccgggtccctagcgggttgacaaataaagatacttcaagcaccggtaggtacctccaatcattaggtttcggggaaagcccctttaatattgttattttggcaaatttagcaaaacttgtaaagtaatcaggtttggctagcatcatttttgggactaacggagccgttatgatagaatagttgatagctacggagggaatcaaatgattgaagactggcatgcgttcttgttgccctatcaacaagcagttaacgagttaaaggtcaaactacggggaatgcgcaagcaataccaagagagcgcccaacattcacccattgagtttgtcactggacgggtaaaacccgtagatagcattaaagaaaagatggttcgtcgtcacgtttcagaagaccggctagaacaagatatgcaagacattgcgggtttacgtattatgtgccagttcgttgaagatatttacgcggtggtggacctactgcgtgaacgcggtgatattgcgattttagaggagcgcgattacgtaactaacgttaaaccaagcgggtaccgctcttaccacattgtaattgagtatccggttcagttgatcaccggtgaaaagaagatcttagccgaaattcaggtgcggacgctggcaatgaacttttgggccaccgtggaacactccctgaactataagtaccagggtgactttccgacgaaactggctgatcgcttgcaacgggcggccgcggcggcgtttaaactggaccaagaaatgtctgaaatcagagaagagatccaagaggcgcaaaacctcttttcttacgggaagtcttccggttgggaacgggccagtggccgtgaccaggaagaacaaaatgataatcaccaagcttaaggggcataaaagagatgaagattgcagtctacacataccgatcaaccgaatcaatgcgggttcgccaagccattttggatggcattcaagggaccccactcgagtatgacgaggatcacccagacatcgtcattaccatcgggggtgacggaacgcttttgtcggcctttcaccgttaccaacacgtacttgatcaagtacgttttgtggggatccacaccggccacctgggcttttacaccgattggcgcaattatgaggttcaagaactcttaaagagcctgcaaaacgatagcggccagtcggtggcctacccactattagacatggaagcaacgatgagcgatggacgggtcaaacacattgtggccctaaacgagtctactttgcgtaacattgttaaaacaatggtgtgcgacgtttacgttaacgatcagctgtttgagcgtttccggggtgatggactgtgtatctccaccccgaccggttcaacggcctacaacaaatcagcgggcggcgcaatcatggatcccaacatcattggcttccagttagccgaaatggcctccttaaataatcgcgtcttccgaacgttagggtcgccggtcatctttggcaccgatgctaaactgaccttccgcttgcgtgatgattcctcggccgttttaacctgcgaccgagaacagatgatgttagggcaagatgattggcacctccaagaaattacctaccgggtggccaaagaaaaaattcactttgccaagtaccgccacaataacttcttcatgcgggtgaagaattcctttatcggggagacctactaatggaatttaagtggcactacttgggcgagcaaccacgtcggttacggtcggtctttcgctcctttggggtgactaattcgctacttaaggtggccatcttccatggcggtcagatgaggatcaatgatcgggtggcgtgggccattgaccaagttgagcccggcgacgtggtttatttagtggttcctaatgagccggctaatcccaccatcacggtcagtgaccaaacctttgaaatcgcttatgaggatgaagactttttggtgattaacaaggaggccggcgtggccaccgttcctgcccatcacgtcgccgtccaagacagcctggtcaaccgggtcaaggggtattaccaacggcaaaattaccccaatcaagtgacccacgtggcaacccgcttggataaggatacgtcggggctagtggtttttccaaagcaccgcttcgcccacgcagtcttagaccgccaactgaaggcccgccaagtcaaaaaagagtacttggcaatggtgcaggggaggttaaccgtaagtcatggttacatcgacgccccgatccgccgggatccggactcctttgtgaaacggttggtggctccggatggcaaggcatcggcaaccgaatactggtgtgaacgggtgacagatacgactagtttggtacgagtccgcttacacacgggccggacccaccagattcgggtccacttttcctttttgggccatcccctattgggagacgatatgtacgggactggctttgggatgccccgtcaagccttgcattgtcaacgggttagtttttactctccctttaagcagaaggtaatttccgtcgccgccccactgcccacggactttcagcgggctgaggatgagtggttaaactaaaagcccccacctagttcgaagggaaccggtgggggtttggcatgtcctaggtggacttatttaacccactgcttaacgcagacgggttctgggcaggcaacatcttgttgaagtaaggttaactgaccggtcgtggtgtcacgagcgtagagggttaagttatcgccattttggttggaggcaaccaggaaggtttcgtcttggctcagttcaaagtcacgtggaaagtcaccagccgtggtgattgattgaatgtgactcagggttaggtcatcattgacggcaaaaacggccagggtgttttctccccggttagaggagtacacgaactttccgtccgaagagatgtgaatggcggcggccccgttgtgggcggtccaatcggccggaatcgtagcaacggtttggacgtgactgaagctgccagtttcagcgtcgtacttaaggacttccagcttggaactcagttcacccaaaacgtaggcaacttgaccgttggggtggaagacgaggtgccgggtcccaaagccagcctctgactggtagcgggatgcttggatgagcttaccgtcgtcgctaacgtcataaacgaccactaggtccattcccaggtcacagacggccaggcgcttgtcaggcgtcaagtcggcatagtgagcgtggggagcgtcttgttccggcttcggcccacattcgccttggtgagtcacctcatcggtttgggtcagggtgccgtcagaagcaaccttaaagaccgttaccgttcccttgtggtaattggcgctgtatagcaacttccggtcttggtcgtaacccacgtaggccggtggcgcccccgcccccagcttttggtcgattaattcggcttgaccatcctttaattggtaagaggccacgccccccaggtcaccgtcttgcttgatggcgaaaacccggtcgccgacttgttgtaagtaggccggtttttgggaggcaaccacgaggcggacattttccagttgctggtggtcgtgattcaaggtgacggcgtacatccccttgctagtcttgctagtgtaagttccaatcaaaaagtcttcgttcacgatagtcactcctttgttagtttcatcactaataatagcagtcaccgcctcaatacgctaggggaaaccagttgccaacctaactagttagtagaaaggatcgatagtaaagtgaaaaaaattgcgcgggccattcagtgggtgcaaaaccacccgggtctatttatctgccccgtttgcggcgatcaggacttgcgggtggaagcaagttcgttagtttgcgctgccgggcaccgaaccgattttaacaagcacgggttcttgtactttttgcagggaaagagcaatgatgagtacgaccggtcgatgctgactgagcggcgccggttgctagaggcggggttattcatgccgatggttgaggcggtagctaatcaattgccggtggggtcgcaaaccatcttagacgtgggaactggcgaagggaccccgctcctacagttggcaaagcttcgcaaggaagacgacaccttggtgggttttgatatttccaaggcgggtatccagttggcgacccagctagactttgggggcttcttttgtgtggccgacctgcgtcacctcccgtttaatgcgggggcgtttagcgccgtaattgaattcttttcgccgtctgactatcgggagtttgaccgggtcttagcccctaacgcgaccctaatcaaggtgatccccaactccggctacctggcagagttgcgccacctcttgtacggaaaaacgggtcggcacgccgaatacgataaccaaccggtggtggacctgttcatgcaccactatccgggggctaagcaggtcccggttcgttaccaattcccgttgccaagcgaacttcggtgggcaatggttgaaatgtcaccgctgcattggggaaaggaggcccgtcccattgctgaactggaccttggccaactgactcacgtcacggtggacgtgaccgttttggtcggcgaaaaaagatcgtaatttactagcaatccccaacgagtgtgttaaaataacttttagaaatcatttagtagatgacatcgagcaatcgttggtatttattaaagagcacttcattaaagcagcgtttcgccgtggctacaccgagaccctgctttttttgtattttaaacgctgaaaggattcacgatgacaaatcacattgtattatttgagcccctttttccagctaacaccggtaatattgctagaacctgtgcggggactgataccgtcttacacctcattaagccgctgggcttttcgaccgatgataaacatatgaagcgggccggcctggattactgggacaaggtgaaggtggtttaccacgatgacctagtggcctttttggattcaattgacctagaccacctctacatcgtctctaagtttgccgaacgcgattatagtgaggtggactacaccatcgccggggaccactacttcttgttcggtaaggaaacgaccgggttgccagagggtttcatgcgccgttatcctgaaaaagcaatccgaattcctcaagatgacaacaacatccgggcgctcaacctgtccaataccgcggcaattgtgatttatgaggccctgcgccaacaaggcttcccgaacctcgcccgggtgcacaagtacccatttgataagttaaagtagggggaaattatggcacgcaaagcacggacaacgacccgaccgcgggcaaaggccaagctcaaggtgcaaaaccggttggtcaagagcctgagtgggattttggcgatcctgattttgctagtcggcctctttaaactaggcatcattggtaccctagtgatggggttatttgaactgatcggcggggaaacggccccggaactgatggtagtggccattatttattgcctgggcttgactttatacggacgcttcccccgtgtgaaggtccgctggttaagcggggcggtgctcttttacgccggcctcttattggccctgcacgtggcgatgtttgacagtttaaacgcccatagtcattacttattaaccacttggaatagcctgaatcgagcgattattaatggcgacaccaccgtggcgattggtgggggactattagggggacttttgtatagcggtaccgtttatttggtggctgatttgggcgcccaagtgttggcctggctgttgatgttggtcggggtcgtcgttttcttcgacctcccgtggcaccgtgtgattgacgggttggcaaccctcgtgagcgccgccattgctaagtaccgggccaagcaaaaggaggcccggcaagcaccaattaagtcccgggttcaacagcgccaccaatcggggctgctagcacgctttaaggaccaccgcccctcgccaaggaccgaggacaaggacctgccggaaccaatcgccgatcaaccaccacaaggcaacgaatcggcagcggccgttgcgccgagcccgagcccggcccctgcgcctaagatcatggtagcggggcaaccgaagcctagcgaaccagcgagcgacgcgggggcggaaccggaattagccggggccaacggtcaagacgatgacgaagactaccaattgccgccaaccacgcttttaaccgaggtggcccctaccgaccaaaccaaggatttggaggcaatcaaggaaaacaccagcaccctgcaagacaccttgcaatcctttggggtcgaggccacggtggaaaatgttagcttaggaccgtccgtgacgaagtacgagcttcgcccagccgtcggggtgaaggtggcgaaaattacccacctggccgatgacttggccttagccctggcggctaaagacatccggatcgaagcgccgatcccgggtaagtcgttggtcggaattgaagtcccgaaccaaaagatcgccacggtgggcttccgctccttagaagaggccacccccaacgatggccgaccgctagcggtgccactcgggcggaccgtttcgggtgacgtaatggtcgccgatctgaccaagatgccccacctcttgatcgccggggcgaccgggagcgggaaatcagtggcgattaacgtcattttgactagtattttatttaaggccaagcctagccaggtgaagatgctcttgattgaccctaagaaggtggaactctctgtctacaatgggatccctcacctgctatcgcccgtagtttccgaccccaaaaaggcggcccgggccctggctaaagtagtggcggaaatggaacgccgctacgagctgtttgccgcctttgggatccgcaacctagctggctataaccaacgggtgactaaggaagaagacgatgaacatcacccgctaccgttgattctcgtcgtcgtggatgaattagccgacctgatgatgacggtttcccatgacgttgaagacgcgatcgtacggattgcccaaatgggtcgggcggccggtatccacatgattatcgccacccaacgcccctccgtggacgtaattaccgggctaatcaaggccaacgtcccgtcccggattgcctttgcggtctcgtccggggtggattcgcggacaatcttagacgctaacggggcggagcgactgttagggcgcggggacatgctcttccagccgatcgacaagaacaagccgattcgggttcagggggcctttatttccgaccaagacgttgaggcggtcgtcaacttcattaaagaggagcgcccagctgaatacgacgaagcgatggtggtgtccgatgccgaaatggaagcggcccaggaagcggaagatacggatccgctgtttgatgaggcgctggactttgttaccgaccagcagcgggcctcgacgtcaatgattcaacgtcggttccggattggctataaccgggcggcccgaatcctagatgaaatggagcagcggggttacgtttcaccagccaacggtgccaaaccccgtgaggtctaccggcaaccagaagaataaaaaacaacctcagcttattggccgcgttttctgtctaacattcgtaaatacaataaggggctaggagaaagtacggtttctcctagccccttattgtattctagtttatttcccacttgcttcgttgactaggcctagagcaagcctaacgaaacgattgccccgaagatcaaagaaccaagcatggcgattaacatcagccaaacggcgaccatggtgatcttttggaagcgggttttcttttttggcattacaagttcactccatcttcatttgcttttcgttaagtgtaccgcaacctagtcgttaagatcaaattagagcccattgtgtggtagaattaacgggattgtaagagaggatgcggtgcgcgtgaaaaacattattactgaattggtgatgctggtgggctatggcctggttgaatggttggtcaatcgtttaattcgtcggcaaaagaagccggttcacctgttgtgggtttggacaacattattaataattagttgcctaatcaacctgactttttactggtttgcctatccagtgattatttggatgttgatcggaattggactggtgatccaccagttgtggaccagtcaccagttcttgtaccaacggttttggccgcgcttttggcaactgacggtgtttttttggctcgttgccttcgtgctatcgctgttgggtaaccgactaccagtggtttaagtaggagtggaaaatgacccgggggaccggtggttgttgtccactcctttttcttaaggaattaattattggtacccgtggtgagaagtgggggaatgtggtagactgttggtgtagtttttaatttgggggtgagacgccgtgtttatgggtgaatacacgcatacaatcgacgacaagggccggctgatcatccctgccaagttccgctcccagttgggtgatgatttcattatcacccgggggttggatcattgtttatatggctacccattaatcgagtggcaggccgttcaacaacggctggctagcttaccatcgaccaacgcgaacgcccgtaagttagtgcggtatttttattccgcggcctgcgagtgtcagtttgataaacaagggcgggtcaacttaccggccaacttaatgcaacacgcctacttagagcggaattgtgttgtaattggggtcgcctcccactttgaaatttgggacgccgagcggtgggcaagttaccaggatgctgcagcaagcgattttgaccagttagcagctggttttgatgggcttagcttttagaaaggaggaacgagatggcagaatttaaccacgtaaccgtgctacttcacgaagcggtggcggggcttgccattcagccagcgggtgtctacgttgacgccacgttaggtggtggtggtcacagtggcgagatcttaaaacaactcaccagtggtcacctgtactcctttgaccaggatgaaacggcgatccactataaccaagctaacttaggcccggcgattgaagagggaaaactaaccttaatgcagaccaatttccggaacttaaagcaggccctagctgatcagggagtcacagcaattgacgggatcgtttacgaccttggggtatcatcaccccaattcgatgatgccaagcggggcttttcctatcaacacgatgccccattggatatgcggatgaaccaagaccagcccttatcggcttaccaggtcgttaacgaatggtcataccaagaactagtccggatcctctaccgctacggggaagagaagtttgccaagcaaattgcccgggccattgaacgggcgcgccaaaagcaaccgatccaaacgacgatggagctagccaacatcgttaaggaggcgatccccgccgcggctcgtcgccacggggggcatccggctaagaagagttttcaggcaattcggatcgccgtcaacgacgagctaggggcgctggaggattctttagaacaggccctggcgctcttaaaagttggtggtcggatttccgtgatcaccttccagtccttagaggaccgcttggtgaaaacaatgtttaaagaggcaactagtttaccggacttaccgccgggcctgccggttattccagcggacgcccagcccgactttaaattgatcaacaaaaaaccagtgctcccaaccgaagacgaattgaaggttaaccaccgggcgcacagtgctaaacttcgcgtgattgaaagacttaaataaagataggtagtggaaaacatggcatcgaacgcagcacgacaactaacctccccaaccccgagtaaaattccggccccgcagccgacgcctagcccggccgctaaaccgggacgggtccccttttcaaattttgaaaagttaaccatcgtcctggcggtggtgatggtgatcgggatgacaatcgctttagtcaccaccaagattcaaaccaccagtcggcaacaggttttacagacgatccagcaaaagatcacgacccaaactagtcaaaacactagtcagcaacaagaaattggggagttaatgagtcagtcgcacctaaagaaaatggcggctaagtacgggttaacggatacgagcgctagtgtaaggaacgttaataagtaatggataagcgccagcaaaagaaacgaacgataaatggggagaacaggcgaaaccgaaagacctttgggatgtggttctttttggtagcggccataattttcattctgtttaccgttcgttttagttatattgccatctttaaggatgttcaaaaccataacttaaaatcgcaggcggccaagctctacactagctcgcaagtgattcaagccaagcgggggacggtctacgatgccgacgggaacccgatcgccacggacactagcaagtacaccgtttatgctatcattgattccagctaccgctcggcaagcggcaaggccctgtacgtcactaacaagaagaagacggctaaagtgttagctaagtacttagacctaagtgaagcccagattctcaagatcctctcgccaagtagtaagggaatctttcaggttcagtttgggacggccggctctaacctgtcagtcgccacgatggaaaagattaaaaaggcaaacctaccagggattaacttcacgcaaatcccggcccgggaatatcccgagggcaactttgctagccagctgctcgggatgaccacgttaaaaaacaacaccaaaaccgggaccacccagttagtgggggacatggggttagaagggtactttaacaaacagctgaccgggacgaatggttaccgaaccgtaaaacaagacgtttatggttaccaactggctgattcgtcaacgaaggggcgtaaggttgaaaacggggataacatcaccacgactttaaacaataaggtccaacaccagatggaaaccttagtgtccaaggtggaaaaggaaacccaagcagaagggattaccgccatcgtgatggaagccaagaccgggaaaatcgtggcggccacccaacggccaaacatgaagtccgaaaccccttcttggaccaacgcattaacgcagcaaacctttgaacctggttcgacgatgaaggtgctagccttagcagccgccattaacagcggaaactttgaccctaacgccacttacacctcaggaacgtggagccttggtggggggaagatcaccgactgggtaaccagtgggtggggaaccatcacctataaagaggggttttaccgctcctctaacgttgggtttgcccacgttgaacaaaacatgggcgccaagacctggatgaaatacattcgccgctttggcctcctaaagaaggtcaacgtatacggcatggggaacgaaacggcgggttacaccacctttaagggaaagctagaacaggccaacaccgcctatggtcaggggattaccgttaacgtgatggaactgatgcaagcctatactgccattgccaacaacggaaaaatggttaagccctactggatcgaaaaggtgaccgaccccaacaccggtaagacggtgaagaaactgtcaaccaccgtggtggggcacccaatttccgcttcgacggctaaacaggtccgtaagtacatggaaggggtcatttacaacaaggtcggaactgggcagtcctataaggtcagtgggtaccggattgccgggaagaccgggacggcccaaattgccgggacaaacggttacgagaccgggacgaatgattacatctactcttttgccggctttgccccggctaaaaaccccaagtacatcatctacctatcgatgaaaaagccgaagaatttaactaaggcggcggaaacctacctgtcgtcaatttcaacgccgatcatcaagtaccttttggaccaagaaaagctcaagtccgaggggcaacaaggggtagtcaaggttggtaactacgtcggcaagaatgcccaaacggtgcaaacaagcctggcgaaaaagaagttgcaagtcaccgtgattggtggcaataaaaagatcaccgcccagtcgttgacggctggtaaagaggtgatcatcaacagtcgtttgatcttaaagaccagcggcgaaatgacgatgccagacgtttctggctggtcacaagcagacgtggcccagttggcacaaatgatggggctaaaactatcattaaccgggagcggctacgcaagtaaccaatcaatcagcgtgggcacccccgttaaggcgggcgacagcttgaaggttgcttatacgggaaagtaagaaagagaagaaaaacgtttaattggaggcaaattaatgagtatcttggtagcgggcttaaccctggtgagtgcatttttgatcacctttttgttaatgccgagtttgatccgctatttccgggcgaaaaaagagggccaacagattcgagaagagggcccaacctggcacgagaaaaaggccggcaccccgacgatggggggcttactcttcatcttgtcagcagcactaacctgcggctgggtgggggcttggcaaggccaactgaatggtaccttaggcgccctgttgttcaccctgatcgcttacggcttaatcgggatgtgggacgacgccattaagatctttaaccaccaaaacgaagggtttaagccgtggcaaaagttcttagctcaggtagtgggggcaatggtttttgccgtcatttaccaacacgagggatttcaaatgggctttgggctcaccgactggggctggttttacgccctgtttattatcttttggatggtcgggttctccaacgccgttaacttaacggatggactagacggactggtgaccgggttagcaacgatttcctttgctgcttaccttgtcttagccttagtacaggggcaaactgaagtcgccctcttctgtttggccatgatcgggaccttgttaggtttcttccccttcaaccacaagcccgccaagatttttatgggggatatgggatcactagcgttaggggcaagcctggcggcggtcgccctggttttacaccacgaatggtcgcttctgatcatcgggatcgtgtacgtcttggaaaccctgtcggtgattttgcaggtcgcatacttccggcggacgggcaagcggctctttaagatgacgccgattcaccacacctttgaaatgatggggtggagcgaatggaaaattgacagggtcttttggctcgttggtttaattgccggcgcccttacggtggcgacgatcttgtttttaggataatacttggatgagtttgaggtacggattgtgaagcaaattaatgattacaaaggcaaaagggtactggtattagggtttggaattagtggtctgaacgccgcttacctcctccaaaaactgggggcaacggtggtggctaacgatcaacaggttccaaaggacccgcgcgtggtcgccgacttggaaggggcggggattacggccgtgaccggctctaacccgctgagcctggccgaagaaggctttgacctggtggtaaaaaacccggggatcccgtatgatacgccgttagtggcggcctttgttaagaagggaacgcccattatcaccgagctagagttaggttaccaagtctttgcggggcacttgatttcggtgaccggctccaacgggaagacgaccaccacgaccttgattgaacagatggtggccatgggtaacccgcaccgggtggagtacgccggtaacatcggggtgtccttttccaaggtggccgaagagctaggtcctgacgatacgatcgtcaccgaagcctccagtttccaactactgggcgccccaacctaccgcccccacatcgccgtgatcaccaatatcttcgctaaccacttggactaccacaagacgcggcaaaactatattgacgctaagctggggatcacccgcaaccagaccaaagacgattacctggtcatcaactgggataaagaagaatggcaaaagctagctaagcggaccaacgccacggtggtcccgttctcccgtctcgctaagtctcaggagggggcctaccaaaaaggcggcgacctatactggcgacaagaacggatcatggccgctaaagacgtggtcttaattgggccccaaaacgttgaaaacgccctggcagccattgcggcggccaagttatccggggtcgcaaacgaagcgatcgtccgggttttgaccaccttcaccggggttcgccaccgccttcagtacgtgttggactacgaggggcgccgtttttacaatgattccaagtcgaccgacatcgaggcaacagaggtggccttgcaagggttcgagcaaccggtcatcttacttgccggggggcttgaccggggctacaccttcgagcgactggttccttacttcagggagcacgtcaaggccttaattgtcttcggtgagtccaaggataagatgaaggcggctggtgagcaggctggcgtgaagacgattgtcgaaagcacggacgcggtgacggcggttccagaggcctggcggcttagtgaaccgggcgatgtcatcttgctctccccggctaacgccagctgggaccagttccccaactttgaggtgcgcggggaccggttcattgaggccgttgaacaactgaccggcaaaaaggaggaaaactaatgcgcttaatggtatcggggggcggaaccgggggtcacatttacccggccttagccctaattgagcggttgaagcaggtggaaccagataccgaggtcctttacgtgggggccaaacggggcctggaaacgaagattgtcccccaggcgggctaccggctggaaaccatggaagttcaggggttccggcggagcctttcgctcgaaaatgttaagactgtctacctctttttaaaggccgttgcccaggctaaaaaactaattaaagactttcgcccagacgtcgttttggggaccgggggatatgtttccggggccgtcttatatgcggcggccaagctgggggtgccaaccgtcatccacgaacaaaactccgtggtgggggtgaccaataagttcttagcgcgttacgtgaatgaagtggcgatcgcctttgaagcggcccggagccagtttgccaagtcgtcagtgacgatgacggggaacccacgggcccaacaggtcgcccagcgcactaattcggcctattcctggaccgaagacgggcttaaagacggggtacccaccatcatgatttttggtggttcccaaggggcgccccgaatcaataaggccgtggttgaggccttaccaagttttaacgagcagccctaccaagtgatcttcgctaccggccggaagcgctacgatgacgttatgggggcgctagcggggcaaccaattggtgataacgttaaggtggtaccatacattgaagacatgccagacaagttgccacacgtcgacgccctggtttcgcgggcgggggccacgacgatcgccgaagtaacggcgctgggaatcccgacgatcctgatcccgtcgccatacgtgacggcaaaccaccaggtgaaaaacgcggaggccctcgtcaaaaagggggcggccctgatgatcttagaggatcaattagacgggcgttccttaattacccaagccaatcacctgatgaatgacgccgccgtccggcaaaagatggcggctaattcaaaggcggttggtcatccagacgctagtgaccaactaatcgccgtcttgaaaaaggcgatcgcagaccaccagaagtagaaaggaggaggggaacatggccaatcaccgtgataaccgggagcaccgccgctacgctgatcgcttggcgacgctagaagctcagagcgtgattgatgggcgtgaccggtttaaaaagcgccaccaggggcttaaaaaggggctccctaagctacgggcctatcaaatcaagagtaacttgggccgggccttgaccgtgttaatccccttcttcatcgttttactggcgatgatctacgtggtttcacccttttctaaggtcaaccaggttaaagtggttggcaatgaggacctgaccgcaaagcaagtggaagccgccagtggtgctaaagctggtgccttcatctggcgcctggtttttgaccaagccgcggtttccaagcaggcgcagcaaaataatttacaggtcaaaagcatccgggtgagcctcgttggcccccggtcggtgaaggtacacgtggtggaaaacccggtgattggaatcgtaacccataacggccaccaagaactcttgctttcgaccggaaagtaccaaaagattagtaacaacctgacgaacttcattacttacgccgggtttgccaagcacgagggaatgctgaccgaaacggccaaacaagttggtcagttgtcggcgacaattcgtcagggaatttcccaagttacttatagcccgacaagtacggatgacgaacggctaaagatttacatgaacgatggtaataccgtgttagccaatgcctcgaccttagcgcagaaaatgaagtactacccgtcgatcgtcaccaatatgaatacggcgggggtgatcgacttacaagtcggtgcctactcgtatgcttatggcgatcaaagtaagtaagtccggaaccggattcatttttgacaatctaggggtttttggacaaggactttctgtggtaaaatttagactaactaaaagtgtaaactaaaggggatttcccttacttttaattaaaatatttttaggaggttccgggagaaatgaacgactcacacatctacgtaggattagatattggaaccacctcgattaaggccctcgtttgcgaggacgttaagggcgaactaagggttgtaggcgttggcacgcaaccggctggtgggcttagtcggggcgtgattgtcgatatcgaaaagacggcccacgccattcaagcggcggttcgtcaggcaaccgagaaatccggcattaagattgataaggtgattgttggtttaccggcgaattacctgcaaatgaccgaggtccacgggatgattacagtggctaaccagggtcaaccacgcgaaatcattaatcaggacgtcattgacgttgcctcggccgcaatgacccaaaacctacccccagagcgggaagtgattgaccttgtcttgcgtgacttcgcggttgatgattttaacaagattgaagacccccggggaatggtggcggtccgcttagagttgcgggccaccatgtactcgggccctaagacgattgtccacaacaccaaaaaggcggtcgccttggcgggcttacagatccaagacttggtggtagccccgattgcaaccggctttgaattattgagtgatggggaacaagacttcgggacggtcttggttgatctcggcggtggtcaaaccacgaccagcatcatccacgaccaccaactcaagtttgcctacgtggacccagaagggggaaacttgattactcacgacatctcaacggtcttaaatacctcccagcgaaacgccgagcaactaaagcgtgatcacggctacgctgattcacgccaggctagcgatgaggtgcaactggccgttgacgtggtcgggaaaaatcagccggtcaattacagcgaaaagtacttagccgaagtgattgaggcccgggtccgccagatctttgaacggtcccaaaagaagcttcagtccattaacgccccgcaactaccagggggcgtggttctcctgggtggggtcgccattttacctggtattaaagaaatcgctagtgagtactacgatggcaacgtcaaggtgtacattcccgaccaaatgggggttcggcacccaagttttgccctggccattgccctgtgcaaatacgaagatgacctgcgtgacgtcgaccaactcctaaaggaaacggtacaccaagagggcaactttgccagtgtggttcaccaggtagtgcaacaagctgcccaaaccagtgcagcaccgcaaccaactcggcgtccggccccgagtcggcccgctccacagccaagtcaaccggaagctcaggcacaagaacaaccggtagacaaccaaccaactaagaagaaaaagaagaatccgttttcgaacttctttaacaacttctttgattaacactgataacgacggaggaaacagtcatggataacgcaaccaacgaattcgatcaattacacccaacccaggcccagattaaggtaatcggggtcggtggtggtggtgggaacgccgtcaaccaaatgattaacgaaaatgttgaaggggttgacttcatcgttgccaacaccgacctgcaggccttagagggttcccacgccaagactaagttacacctggggccgaagctgaccaggggcctgggggccgggtcaaacccagaggttggggccaaggccgctcaagaaagtgaatcagacatcaccaaggccttagaaggggccgacatggtctttgttaccgccggaatgggcgggggtaccgggaccggggccgcaccagtaattgccaagattgccaaggactccggtgccttaaccgtcggggtagtaacgcggccgttctcctttgaagggacgcggcgggccaagttagctgccgaagggttagagaacctggagaaaaacgtcgacaccctgatcgtggtttccaacgaccgcctgttagaaatcatcgacaagaagacgccgatgatggaagcctttaaggaagccgatgacgttctccgccaaggggtggaagggatctctgatttgatcactaaccctggttacattaacttggacttcgctgacattcgtcacacgatgaccaaccaaggggccgctttgatggggattggggccgccggcggtgacgaacgggccaaggaagccaccaagcgggcgatttcttcaccgctgctggaagtttctatcgatggggctgaacacgtgctggttaacgtgacggggggcaaggacttgtccatgaccgaagccgaagacgcctctagcgtaattcgtcaagccgctaacaccaacgtcgacattacctttgggatggccattgacgaaaccttaaacgatgaaatccgcgttacggtaattgcaacggggatcgacaagaccaagcagggcgacgaaaagccagttgaagaagtaagtcagccggccgcacagccggtcagtcaagccccggttcaaccacaggttcaggcacaaccacaggctagtgccgccccggccccaacgtcggaattcgcaaccaccgatgacccgtttcaaaactggaacgaagacctcggcaacgaactagaaggtggcgcccggccgaatagctttaaccacgtcaagaagccaaccttcagcgtccaagatgacaacctgtctaacgttgatgacgggggggaagacctctctaccccggctttctttaagaaccgccgcaagtaacacgaaccgaaaatagaaaatgactggaggaatggcccatggcaagtaaattttttagcaacctttttggggtggtcgacgatgaaccagagacggccgactactacgaagatcagcagccggctcaacaagccccggccccggtgccgactccggccccaacgcgttcaaataaagtcgtttcgatcaataacgcccgagtggctccgcaaccaaattcgtctagcaagattgagctagttgaaccacgggtgtacggggacgggaaggaaatcgtcaaccacctgttaaatggcaacgccgtcattgttaactttgatcagatggacgcaaaggttgccttccggattgtcgagtacatgaagggcgccacctacgccattagcggaaagatcgaacggattgacgcagaaattttcttgtgcaccccccaaaacttcgaaatctcggggaaattagccccgaccctttctagtgatgggttggatgataggggagaccggtattgattattacctttattgtttgggcgcttagccgcctgttgagtttgtatagcctactgattgtgatctggtgcctgttaacctggtttccgggggccatggatagctcactaggccgctttttaagccagctagtggcaccgtacctaaacttttttgaacgagttattcctccactgggcgggatctcctttgccccggtggtggccttgattgtgatttattttgcccagtatggggttcaaatggttgggcaaatcctaatcaacttaatgtagggggagcatgatggagcaggtgaacgtcaagcagcacttccgggcggatgaagccccgtttattgaccaggttaatgattggctgaccacggccggcgaccaataccgtccggtcctgaccgcctttttaaacccccggcaacgttatatcatgcgggtaattgccaatcgtcaagacgaggtcaaggtggcctttaaaggcgcttatccgggcgccgaaatgcagcgcggtttagcttacccagcttattaccagccgacggaagacgatttcgaattacagctgttagaaattaactacccccaaaagttcgcggagcttcatcatcgacaggtaatgggagcggttttgtcaaccggagttgagcggggggcctttggtgacattatcgcaagtgatgagcattggcagattatcgtacaaagacaattaagtgactacctgattgaacaggtaacgtcaatcggtaaagcaaaggtgcgcttagaaaaacgggaattgcaaggggcccgggcaccgcaagaagattggcaagaactcgtcaccacggtcgcttccttacgtttggatgccgtggtggcggccagttttaattattcaagaaaccgggctaagcaactgattgaacgcggtcaggtccgggttaactgggaagaaattgaccgtccggattatgagttagctagccgggacttgatttcggttcggcacggcggccggattaaggtgcaagaggagcttgggcaaaaccgtcacgagcgcactagaattcggttagccgtcatccatgcatagtggacagcgattggaggaactagaatggcattaacagcggaaaacattacaagcaagaaatttgatacgaaaatgcgcggttacaaccaagctgaggtcggggcctttttaaatgaggtagcggcaacggtggcggaactaactagccaaaaccgggaattgcaagaagaagttcgggccaacgaagagaagctcaaatactttgccgacttaaaggactccttgaacaaatccattttggtggctcaagaggcggccgataaggttaaaaacaacgctaaaaaggaagccgagattacggttcgcgaggcccaaaagcaggcgactgacattgtggcggccgctaacgaaaaggctaacttggtgatcgaaagggctgctgcttccacccggaagttgaccacggaaaccaatgacttgaagaagcaaacccggatcttccgtcagcgcctgcaggtaatgttggaatcccaactggaagtcgttaagtcaagtgaatgggacgagctgttggccaacgatgatatttcccaatacgatgaaatcgaaaagattttaggatccaatcttgacaaaaattctgagggcagtgtagaatctactccaatagccgaagaacaaccgagtagtcaagcaccggcaccgtcaaacgcggcggaaccggctgcggctaagacggtcgtcatcttcccggacggggaaagcaagtaggcgaacattaaaacgacgattaaaagcattgatgggaacccgtacgaaacgtcgacgattaagcgagccggtggttggtgcaagaccggtatcaagaccttcaagcaaatcatcccagagcgtggtactgaagcgagtaaggaccaccggttcatgaccgttaccaaatgacaaagcaaaaggagcagtccttttgaaatttgggtggtaccacgagtgcgtctcgtccctttgcggacgagacgttttttgtttttaagcgttggattttaaccagagaagggggatttaagatgcgcgttaaagacaccttaaaccttggtaagaccaagttcccaatgcggggacggctcccggaaacggaagcgcagcgagaagcgctgtgggaagaaaacaaggtttatgaacaacgacaaaagttaaacgagggcaagccaagctttgtgcttcacgatggccctccatacgccaacgggccaattcacattggtcatgctatgaacaagatttccaaggacttcattgttcgctacaagtcgatgaccggctaccgggctccgtacgttcccggttgggacacccacgggttgccgattgaacaccaactgactaaggctggctacgaccgcaagaagatgagcttaactgagttccgggacctgtgtcaaaagtacgccttggagcaagtcgaaattcaaaagaagggctttaagcgcctcggggttgccggggagtgggatcacccatacctgaccctggccaaggaatttgaagcggcccagatcaaggtctttggtgcctttgctaagcggggactcttgtaccaagctaagaagccggtttactggtcttggtcttccgaatccgccctggccgaggccgaagttgaatatcacgatgtcgttgcgaagaccgcctttttcaccgaacaggttcaggatggcaagggactgctcgattccgatacttacctggtgggctggacaacgacgccatggacgatcccggcctctgaagcggttgccgtcagcgctgacttcgaatacgccctggttcaaccgagcggcagtgaccgtaagtacgtggtcgcagctagcctgctgggcgatttagcccagaagtttaactggaccgactaccaggtggtcaagacctttaagggtgccgaaatggaagggatgaccaccaagcacccatacattgaccgtgagttgttagttggcctggctgattacgtcactgatgacgccgggactgggttggtccacaccgcacctggttacggggatgatgactacaacttcgggaagaagtacaacctgccgatctttgccccaatgaatgaccaaggggtactaaccgccgaaaacgggccggaatttgacggggtcttctaccaagacgccgatgatatttccctgcgcctgttagaggaacacgacgccctgcttttagaagaagacttagagcactcctacccgtttgactggcggaccaaaaagccgatcgtcttccgggcgaccgatcagtggtttgtctccatcgacaagatgcgcgacgaaatcttaaaggccgttgacgaagtgacctactacccgacttgggggaaggtccgcttgcggaacatgttaaaggaccgtggtgactgggtgatctcccgtcaacgggtctggggggttccgttgccgatcttctacgccgaagatggcacgccaatcatgaccgaagaaacgatcaaccacgtttccgacctctttcgggaatacggctccaacgtctggttcgatcgggaagccaaggacctcttgccagcgggcttcacctctgaacactccccgaacggcaagttcaccaaggaaaccgacatcatggacgtctggtttgactccggctcgtcgcaccaaggggtgttagccgaacgcgattacctgacttacccggcggacatgtacttggaaggttccgaccagtaccggggttggtttaactctagtttgatcacctcggtggtcgtttctgggcacgccccgtacaagtccgtcctctcccaagggtttaccttggaccagagcggtaagaagatgtccaagtccttagggaacgtgattgacccgaacaaggtggttaagcaaatgggggccgaaatcattcgcctttgggtaatgtcggccgacacctccgccgacgtgcgggtgtcaatggaaaccctgcaacaaatctccgaatcctaccggaagttgcggaacaccttccgcttccttttggcgaacaccagcgactttggaccggagaactttgttgcctacgaaaagcgcgaagccgttgatcagtacatgacggttaacttcaatcgcttcctggccgggatgcgtgatgagttcgatcgttacgacttcttaaacgcctacaagcacttaattaactttgtcaacaacgacctgtcatccttctacatgaacgtggccaaggacgtcttgtacatcgaaccggaagactcccacgttcgccgctcgatgcaagcgaccttctacgaaattcttagcggcctgaccaagctgttgacgccgatcttgccgcacacaaccgaagaagtgtggtcctacatggatgaaccggaagacttcgttcagttaacggaaattccggaagcccggacgtttgaaaatggcaacgccctgcttgaaaagtgggaaggcttcatggaattacgttcccacgtccttaagtgcttggaagaagcccgtaacgctaagttaattggtcggtcacttgaagcgagcgccgacctgtacctgacggcttcccaacaagaattactagctgacctcgggaccgatgcgggactcttgtgtggggtttcagcgctgagcgttcacgacgctagcgaggcaccagcagaagccgaaagcttcagtgataatgcggccgtcttagttcaagcggccaagggtgaagtgtgtgatcgttgccggatgaccaaggaagacgttggctccgatccggcctaccagcaactctgtgcccgctgtgctaagttagtacgggaaaacttcccccaaacggttgaagaaggcttagaaaagtagtcgctacctggtgactggtgtaaaataggaacgaaagacgttgggcaaaccagcgttgagcgctccgtacaacaaaccgcttgcgctcggatgacgggtgtgggcgggtttttgcgttggcgggggaaagtaggtgaaaagatgattcaagcaacgatcaagagttacgaccccaccaagggttggggctacattaccaccccacaagatggggatgtttactttcaccggcgggccattgaaggtcgcagccgggtcccgattcaaaagggacaagcagtcgagatggtgattgttcaaggccaacggggaccccaagcggcccacgtaacgattatgcaacgggaggattaagatggactttgaagaaaaagttactggacaccaaccggtttttagcggccatttgattgacgttgaggtccaagacgtgctgaccccggcggggaaccacgccactcgggaggtggttcaccacgccccggccgttgccattttggccctgaccgatgacgaccaaatgattttagaacagcagtggcgggccccggtaaagcaggttaccctggaaattccggccggcaaagttgacgatcgtgaccaaggggacttgcgggcctgtgccgtgcgggaactcaatgaagaaaccgggctggcggctgaacaccttgatcaggttaacgcgacggctagttcggtcggcttttctgatgaggtaatcaccctctttgtggctaggggattacgcccggttgaccatgccctaccaaaggaccaagatgaagaattgagcctgttgaaggtgagcttgaaggaagccttagagatggtggccacggggcaaatcatcgatatgaaaacggtgatggccatttattactgggccagtcaacgggtgaactagatgcaagagccaaatgaagaactgagtcggcgccacttacgcaggcaagctggtgatcaagcggcaccggacgctagtggcgacgtgacgatgacccgccaggaaagcttggagctcgccaaaaaggagcgccaggagatggccactaggcagctcaagcggcggctcaactgggtgatcttgggtttagtggtagcgatcgtaattgtttatttgattctctttttcgttggttagaaaggaagtaccatgacatttggaattatttgcgccatgccagaagagttgcatgccctgagtgagcggttaactgatcgcaccgaaaccgtgttggggggaaaaacctacctagcgggaacgattgaaaaccaggcggtggtcctggtggaatccggaattgggaaggtggaggccgggattacggccgaacacctcattaccgactttaaggtcgacgtggtcattaactccgggtcggccgggggaattggcgaggggctgcacgttggcgacgtggtgatcgcgacggaaacggcttaccacgatgttgacgtaaccgcctttggctacgaatacggccaactgccagcccagccggcccggtttagcgctgacccaacctgggttgagcgcattagtgaggccggcaaggagaccggcttaaacatcaagcagggcctgatcgtgacgggcgaccagtttgtgtcctctaaggcaatgattcaacagattaaggcccgctttaatgacgccctctcctctgaaatggaaggggcggccgtgggacaagtagccactgaccaccaagtaccgtacgtagtggtccgggcaatgtctgataccggtgacgagaacgccggggtgtcctttgatgaattcatcgtcgaggccggtaagcgctcggcggccatgctcttgcaactctttgctgatttgaacaagggaggggtggcgtaatggcgtaccaagcatccgttcaagtgcccggggaccaaacgacctacgcaattagccctaacattaagaagtactccctgattgacctaggttttgaacaaacccgccagggcaactacaagtacaccggctccctagaccggaccaacccctttaagccggccgccaagctacaaatcaccgttaacgccgaattaacggggtttaagatggatacggttagtgccaatggcttgcgtaagatcaatatcttcaccgggccgcgtagcgaggaatttgtgacccagtaccacttcatccttgatgaaatggtggccagggagattctgaccaaggtaagttagtttgatagcatcccgggcgtgtctttggtacaatggtaaatactggacatgcgaccttcaatcgtagatggatccagaatctattatgaaatgatggtgattttgcatgactgataacagtcatacccgcgttgtcgtcgggatgagcgggggcgtagattcctccgtgaccgccttgttgttaaagcagcagggttacgatgttgtcggggtttttatgaagaactgggacgacaccgatgagaacggggtttgtaccgcaacggaagactataaagacgttgccaaggtggcaacccaaattgggattccgtactactcggttaacttcgaaaaggagtactgggaccgggtctttacctacttcattgatgaattcaagaaggggcggacgccaaacccggacgtgatctgcaacaaggagatcaagtttaaagccttcatcgagtacgctaaccagctcggggccgattacgtcgccaccggtcactacgccgacttaaagcgcgacgaagccggtaacatgcacctgatgcgggcaaaggatcaaaccaaggatcagacctacttcttgagtcaactcgaccacgcccaattggacaaggtgctcttccccctggctggttacaccaaaaaagaggttcgtcagctagccaaggacgccggcctcgtggttgccgacaagaaggattccgtggggatttgcttcatcggtgaggacggtcacttccgtgagttcttgagccagtacttgccggcccagcaaggtgaaatgcaaaccgttgacggtaaggttgtggggacccacgccggcttgatgtattacacaatcggccaacgcaagggcctcggccttgggggaaccaaggagaacaacgacccgtggtttgtgatcggaaaagacatcacgaaaaacgttctctacgtgggacagggctacgaaaacgagcacctttacgccacccacatggaggcttcggatatccactgggttgacgacgtggtcagccgctacgggacggagtttcactgtaccgctaagttccggtaccgccaaaaggacgaaggggtcaccgttaagctgtctgacgatggtcagatggtgaccgtgaccagtgacgatcccgcccgcgccattacgccgggccaagccgtggtcttttacgatggtgacgagtgcttagggagtgccattatcgaccgggcttacaaccaggagcgtcaactgcaatacgtttaattaatattagccggaaatcccgtgactttagtcatgggatggataggccactattgagcccctttatggggctttttgtttgtttctgtatatttttagtcattgatatatttctcgacaacttctttgctcatattgcccaatgtactcatatagtaactcggcgaccaaagatgaccgccccaatattggctacatcgtatttctggatgattctgtaaaaaaatataggcactacgtcctttgagcgccttaatggcactagccggagctttgcttggcggaaaactgatcagcatatgaatgtgatccggcatgacttccatcttttcgattacgatgtcattgtcatctgcaacttgctgcaagatagctttcatttcgttagatatgacctcggttgtaaaagtctgattgcgatacttagttacccagatcaaatgataatggaaattatagatataacgacgagtataaatggtatctttgattttttctttagtcataatatgctctcctttgttaatacattgacatcatgatataatgttatcatatcaataaaggaggtgaaatcaaatgaaatcaatggcaaaaatgaaatatcattatggcctaaaaatgcgctgctatcctagtgaccaacaaaagcagttgattaaaatcaacagtgacgctagtcgctttatctataacgaaatggttgcgatcaataaggaactgatgcagcttcgcagagttaagctaccgattgacatagttcaggatcgtattaagcaactaactatgcgccaaaacgctaagcaaatgtctaatcactatcaattcttagaagatgaacgaattgatagtttgacgaaagctaatgccattcagaactatcgaaaagcttggaatgcttttcggaaggttcacgccactggcgttcccaaatttcatcgaaagagttatcactggcggtatcaaaccaattgtcaatacccggggcaaaaaactgcgttgctaactaacggtacagtctgttttctagataatagtcatgtcaaagtacctaaaataggactgttacgtgttgccggttcgcaagcacggcttttgaaaagaatatgcgagactagaattggtaccgtgacgttgactaaagattcagcggatcgcttctttttatcaatgcagttagcttcagatgaatcttttgttaaagtgtccaaagctactcatggacatgttggaattgatcttaatactgataacttcttaaccgacagtgaaggcaacatagttcctaatccacgatattaccgcactattaaaggcaaattagccaaagaacagcgcattttatctagacggcaacaacgtgcaaaaaaagaacatcgttctttacgagatagtaaaaattatcaaaaacagcgcttgttagtcgctaaactccataccaaggtaatgaaccaaaggcataattttctccaacaaatttctaccgcattaatcaagaaccacgatttagtagtagccgaggagttgcgtagcaagaatttgcttaaaaatcatgctttggcacttagtatttctgacgttggctggcgaacatttcttggcatgttggcttataaagcaaagctttatgggcgtcaatttatcacaatcaacccaagaaatactacccaaacatgtcgcgattgtggctttgtaatgggcactaatgggacggacaaactaacattagatgatagaaactggacttgtcctaactgtggtattcaccatattcgtgactggaacgcagctaaaaacattcttgataagggaatagctaaactagcctagcttatctgtccctatggcaacctggggacataaaaggcgttggtaattagacgaccgctgtttgattacaatttcagttggtcaaataagttgtccctatctacgcaaattgtggttcgaaatccgtgatgatattcggctcacaagccactgactttagtcagtggtggttgacactttaagcgaggctggggaaagaattccctggccttttttgtattccattttcaaagaccaccctcgccactcttacaatttagcctgtattggaggttggctcgcacttccgataacgtgctcccaaccacggacctagtggctaagtacggccggagaacgatgcgtaccgcatcaacccccgtcctagcttagcccaacggtccgtcgagaaggttggctcgcacttccaataacgtgctcccaaccacggacctagtggctaagtacggccggagaacgatgcgtaccgcatcaacccccgtcctagcatagcccaacggtccatcgagaaggttggctcgcacttcttttagtggacagcgctttcttttacgactatcctataagaaaatcaatgaagggaatggtggccatgacactgttgacgaacggacgaatttttctgggaaccggcgagaatgactttgctaaggacctgcgctttgcggatggaaaggtcgtggaaacgggggatgatttaaaaccggctgaaggggaagaagtgatcgatgccaaggggcgcttggtgttgccggggctaattgatgcccatacgcaccccaaatacatcgccgacgcccttcacggggtggcttgtacgccgcctgacgtaaatagcattgcggaaatgcaagcggcgttgcggcattccccggcctttggtgccggtaaggacgtctggattgagggctggggctttgacgaaaccaagctcaaggagcaccggtccccgacccgggccgatttggaccaagtctcgaccgaccagcccatctttatctaccgttctgattgccactcctcagtgggaaactcccgggcgcttgagttagccgggattgaccggaccacccctgatccagtggggggcaagattgaacgcgacgatgccggggagccgaccggctttatgcgcgaggtagccgccacccaactgctaatccgggccaagtcggcgcagagttaccaagccgacgtggacaacctggtccaaagctctcaccactacctagccaatgggatcgtggcgatcggtgagatgatgggacgaaaaaagccgtatgattcctggcaactctatacggatgcggttacccggggctttttaccccggacgaccatttactacgtgtttgacgaattaaaggacggcgccgctctgtcattcaaagccactgaccagctaagggtggccggcattaaggtcttcatggacgggagcatttcgggggaaaccgcggataacacccgcccctacccggatgggaaacggggggtcttgttgacggatcaagacaagttgcttgcggccgtcgagatggccaaagcggccaaggtgcaactagcggttcacgcaatgggggacgccgcgatccagctggttttagacacgactgctaacctaaccccgtggctcagcgagaccccctcggtgcgaattgagcacgcttcgctattgaccgacgccatgtttgaccagattaaccgggccaagatgaactacggcctggttacccagccaatcttctttttcgctgaggtggcgtcctaccaagccttcttgactagcagccagtaccaagaaatctaccgggttaaatcaatggaacgctccaaagcgctggttgcactaagttccgatgcgccctgcaccccgtgggcggaaccggatagtgtcttttacagtctctacgcagcggtcaccaggagggcggctaacggggaggtagttggcccagaagaagccatcacggtgggaacggggctgttagcctacaccaaagacgccgcgttgatgggcggctttgaggaaaacggcaccctggtggcgggcaagaacgcggactttgtcatcgtggatcaggacctgtttaccatcgatcctaccgagattaaggacacccgggtcgccgaaacctgggtggctggccaacgggtttatcaacgtgcggtgggggaaggtaactaatttagccaaagttggtttgcccccttgtcagctccccataaaaggggtattatctaagacatccatgagaatgttagaattagattagaacgatgggggtaaggcttatggcaagaacagttgggatcatcggctccgggcacgtgggagctaccttagcaaacaatttattagtcactggtagcgtggataaacttgttttgattgatacaaatgagctaaaggtcaattcagatgcgacggactttgaagacgcccttgccaacttgcccacccacactaaggtggttaaaaataactaccgggagttaaaacacgcggacgtggtcgtaatcgcggttggttcaattggggttcaaaatgacgacgccaagcacgaccggttcgtggaattaaaagtgactagcaaggcggccaaggaggtggggatcaaactaagggaggtcggcttcgatggggtcttggtttcgattagtaacccctgtgacgtggtcgccgccctctttcaacactacaccggcttgccaagggatcaggtaattggcaccgggacactgttagacacctcccgcatgaagaaggtggttggccaacgctttgaattggatccccgttcggtttctggttacaaccttggggagcacggaaattcgcaatttacggcctggtcccaagttcgggtcttggatcagccggtgaccgcagcgctaagtgaagcggagttggacgaactggccgaagccgttcgggcggggggctacacggtctttcacggcaagcactacaccaacttcgggattgcggcagcggcgcttcggttggtcaccgccatcataaatgatgctcgtgccgagctacccgtctccaacttccgcgaggagctaggtacctacgtgggctatccggccgtggtgggaagcggtggggtcgttcgccaaccccaactgacactcaccagcgcggaaaaagaaaagttattggcgtcagcaaattacatccagacccgctatgaggcggtcctgactgaattagagaagtagaaaagaacgcagggctctagcgaacggtgctagggccttttttagtaagccgggacgtaggtggttcatcccggacgggaaaagacggcggaattcaaaaggaaacccaattttttggtttgtgattttcactcacccggtgatctttggtattatagataacagagaattgttgttagcaaattaagagagcttttttgaggcaaacatgacaaccatttattttattcgacacgggaaaacggagtggaacctggcggcgcgctaccaaggggcgcacggggattcaccactcttagaggcgagtcatcaagacatccgttctttagcggcgtcactggcgggggttaagttcattcacgcctacaccagtcccctaaagcgggcccggcaaacggctgaggagttgatcgctcagttgccaacaccagtggccctaaccgttgatgaacgcctgattgaatttgacctcgggaagatggagggaatgacattttcagccgttgaaaaagagtggccgaccaccgtcgataactttcaccaccatcccgagcggtttgacccaacggtggtgggcagcgagtcctttgaggcggtaattaaccggctcaaagctgccgtcctcgactactgtcaccgctacccgcgggggaatgtgttagttgtctcccacggggcggcgttaaatgccggcatcaacggaattttaggcgcctccttagtcaacctaaagcaacgcggcggtttatcaaacacttccaccacggtaattcagactactgatcaaaagcactttgaactcgtcaaatggaatgatacggagtacctgcaccggacgcaggtggacccaacggacacggtataacggggtgaaactaaatggaaaaagaaacgaagcaacaagaagcacaaaagcgtcaatcggaacaactggtgcaccaattggtggccgctattgacgccgaaccaaacaagtttaacaattactacgagctcggctcccttttgacccgcctccacgattacacccaagccgaagagctgttcttaaaggcgctaggcctgtttgaaacccgcggtgatgaacgggcggtaaccttcttaaagtatgggttagggaacctgtattacgaagtggaccaagtcgataaggcgatcaagtactacaaccaggttgaagacgaaaagatgaaggccgatgcttacttaatgctggcccagtcatacgttaaaaagggccaatataaacaggcggttatgtacggcttgacggcccacgagttagaagaaagcgacccagaaatcagccaggtgctgggggatgccctcttggctctgggcgaatttgagcaggccaaaaagtactacgaccggatcttggttcgccacccgggccgggccgacacccaatttgaccgggggctggtggccatggcgcttggtgaaccttaccaaccgtacttggaacaggcccagcaactgaacccggattactacaagaagagcgaaaagcggattgccgaaatagaaaagaccctgcaggaattaggtgacaaggggggccactaaatggcgtaccgggattatacccagccggtaattcatgacgaaaaggtccaagaaacgggaccaacgcatttttcggggcgggtacgaaaagttatcttttctaacccgccctttgctattttagcggtgacggtgttaaaggctgactttgagtgggacaccgaagaaatcaccgttaagggtgacgttggtcaagttaacgagggcgatgagtttgaatttgagggtcaggttgtcaacaacccgcgctacggctttgagtttgatttttcgggctttgtccaccagctgcctcacgacgccaaggagctggccgcctttttaaagaagaacaacgtggcggtcagtgatgagaaaaaggtggccaaggctattgatgacgccttaggcgaaaaggccatgagcaccctgattggcgacgccgacgcaatcgaagtggtgtccgggttgagtcaaaaagacatcgcgaccttaaagacctttttcaaccggttggtcaaagatgacgaggccagcaaggccaaccgccagttgatgatgctcggtttctcggcctggatgatccgccgcttgcaggaattctaccaacggcggttgcttaaaatcctcgaagaagacatttaccaagtggtagccgattatgagcagttggggattagttttcgcccggtggatgaggcggcacgccagtatcaagacgtggccttcgatgatccccgccgcatcgatggggctctcctctttgccgcccaaatactgattcgggaaaattccggctcgtacgtcgccccgcaattactgttgaaccgggctagccaactccttaaccagggcgccaccgtcagccaggataccctggcggcgcgtttgggaattttactgacccaaaagaagctttaccacgtgcccgagcggggaatctacccggccctgttctttcacgccgaaaatttaatcgccagtcagcttcaccagatgatggcggcggcccagccggtcagtgccaagcggcaaaagctgattgaaaagatagttgatcaggtggccaaggaacaaaaaatcacttacgacgaccagcaaaaggcggcgattaaacaggccttagaagcaccggtgctgctcttgaccgggggaccggggaccgggaagacgacgattctaaacgggatcgtgcgggcataccggcgcctgttaaaagaggacggccaaaagctccacgcttggagcgatggggaaccaattcagttagttgcccccaccgggcgggcggctaagcaagcccgccaggtgatcacgggtgagggcgttgccgcgtcaaccatccaccacttcttgagcattgcaaccgataacgatgccgcccgtttgattgaaaaaccggcgcccctagaaaataccggtcagatgctggtggttgacgaaatgtcgatgacctccaccctcttgatgggggggctaatggcggtgatcccgaccaacatccacttagtgttagtcggtgacttcgatcagctgccgtcggtgggaccggggcaggtgttccgggacttgctcgaatctaattgcttaccgcaagtccgcttggaacggatttaccgccaggacgccgattcctctttgatcccgttagcccagcggatcaacaagggggacgttgacgaggacttcattgcccccaccccaaagactaagtaccccaagcgaatctttgtgaccaccgccgctcgcgacgttccggcccggattggtcagctagtcgacgcctacttgggtggtcacgacttggatattcaagatattcagatcttaaccccgctacggcgccaccgcgacctgattaatagctacttgcaagaccacctgaatccggccagcttaaaccaggccacttaccggttacgaagccgggagatacgggtgggcgacaaggtaatgcagacaacgaacgactccgacgccgaggtttataacggtgacatcgggatcatcaagtcgattgccgggaaagataagcacgtcgttaacggcgatcggctcgccaaaaaggagaaggtgcacctgaaggtcacggtcgactttgctggccacctggttaaatacgatgaccccaccgccctggctaacttagaactggcctacgcgatgacgattcacaaggcccaggggagtcaggcgccggtcgtgattgtgaccttgctgtcggagtttttcccgactaacccccaggctggttcaatcatccaacgtaacctcttgtacacggcggtgacccggtcgtcgcgggctctggtgatggtgggtgacgccccggccttcgtgcgttgctctaagacgccggtggtggaccgccccacctcgctcaagcagcgactgaagttggtttggcaagcagcccagcaggatccagactccccggcagacgagaaagcccagacgccggttcaagaagaacaaccagcggatcacttgacgccggcaatggtggaagacgaacgggtggacccgctgatcggcatggatggattaagtccggccgactttgcctaatctggttgcaagccgggcccaaaattgtgataataggaaaaacgtcactaacaacggaaggacaaagacgatgagtaaaatcgaaaatgccgaaaacgtatccctctttgcgctaaacgcaaaccaaccgctggcccaagcggtggccgatcaggtgggaattcccctttcaaagtgcacgattagccactttgccgacggggaaatttccgtgacgatcgacgaaagcgtgcgggggcgggaagtatgacgaattgtcaaatcaagcgcaactttgtcccgaagaaaacttcaaatggactcttccagcctaagaccttacgtggtcggtgatttaaatccctgacaaacttgtcgatatcttgatcagttagttggtctaggtcggttcctttggggaaatactcacggataagcccgttggtattctcattggttccccgttgttggggcgcatggggatcgggaaaatagactggaatgcttagttcttggctaacttcacggtatcctgcgaattcagttccacggtccggcgtaagcgtccgaacgcgtttaggcgttacggtatgcaggaggtcaatcatcgcttgtgtgacgttcttggcgtttactttgagaacgcgctgagataataaataccgagatttacggtccactaaggttaccagggctgaacgcccggttttaccgcgaattgtatcaccttcccaatgaccaaaccggcttcgattctcacatgaaaccgggcgttcatgaacggaagggacgtcgttaaatcgtcctcgacgttccttaatggttcccttggcctttcgggttttaccacggtgacggagcttacgggcaaagccacgagccccgtgactcttacgtttgatgcctaaattatcgcgttcaatcccacgataaatggtgttataactgatacgccattcgctgttttcgtgggctaaacgacctgaaatctgttccggggaccactgacgttgaacaatacagtgaaggataaaatcccgtaacttcaagttagttagaagcctaggacgtcggctttttagtcgacgtccctgatagttctcttgggccttgacggctgagtaagccttacgaccgccattgcgtttgatctcgcgcgatacggtggctttagaacacccaatcctctgcgcaataacttgataggtgtccttcaaagtgacgcctaatagtatgcattctcggtcttttaaggtaagatggttgtacgaactcatagcctaagatctcctttagatgtttgttgtggtaacttcattttacaggactcaggctatgagttcttttttattttcttcttacttgttgcacttcaattgtaaattcgtcatacgtaattcaatcgatttccgagccagttaacaccaacctgatggaactgttgattatggtcgacgccctgcgccgggcgagcgccaagaagattaacgtggtggttccgtactacggttacgcccgccaagaccgcaaagcccgttcgcgggaaccaatcaccgctaagctggtggccaacctgctgacgatggatcaaatcgaccggatgatcgtcgtcgaccttcacgctccgcaggtacaagggttcttcgacatcccggtggaccacttgctggccgccccaaccctggttaagtacttcatggacgaggggattaccgataacctggtgattgtggctcctgaccacgccggggtgaaccgggtccgccggtttgctgaattaattggcggcgccccgatcgcaatcgttgataagcggacggaaagtaaccgcgaagcccgtcacgaacaattaccaactacggtgattggggaagtggccggcaagacggcgatcattgttgacgacattgtcgatactggttcgcggattgccaactccgccaccctccttaagaagtgtggtgccgaccgggtctttggggttgcgacccacgcggtcttatccggggacgctagccagcgcctgttggattccccactggagaaaatggtggttaccgatacgatcgtgatcccagaagagaagcaaacggaaaacatcgaacaactttccgttgccccgctactcgctggtgccatcaaccggattcacaaccacctttcaattcacgatctcttccaactgccggaagaaggctaataaaaaaactcgcccgcgggcgagtttttttattagattaattcggtttgtacctgtggggtacccttctttaagttggccaagagccggtttaattcaagtcggcgttggtgcttagagatgaaaacccccatcttctcttggtcaaagccggtcaccatcttgtggtcgttaaagatgatcgggttgcgcaagatgtgcgggctcttttcaattgcttgggcaagttggttaatggttagattacgggcgtccatttgcagggccttggtatcatgggagcgtttagaaattaaatcgtcggtcccgtccgtggaaagggcgagcaggtcgaggatttcaggggtcgtcaacggctccttttcgatgtttcgttgactaacggtgatcccgtgctgagttaaccattgaacggctttgcgcttggatgggtcgttagtgtggaaaaataaattgaccatcgaatcactcctttgtaagcttttagacattttagcagttttccttggttagaaacgctaattgactggtaattaatgaattctttagcactcattagtaattaattataaattactttgttcaattaggtgttagaacagaagggcgggtgctaaggaagtgaatatgtatattatactgcgataactaaaaaaagtcctgtcgttggacaagactttgactttatttaacctttttctttttgcgtaagtggcgcacctggcggaaggggtaagaagcggtccccagttccaggtcaacgaagcggttacccatttcctcaccgtcaacttgaccaaactcaagcgaggtggtggtgtagtgaaggtgggtgccgacgaagcggtgggcaaagcgggaccgggccaagtgttcccgtaagaagagccacatcgtccagaaggtaatcagccagttgtggcgctcgacgactaacaactccaggttgggttcggcgaggtcacggtcgggagcgaccttccgcccgccaccgataaaggggtggttagaggcaatgacgataaaggcgttagggaagagctggcgggtgcgctcttgttggaccatcagggtgaagggggcttggtcatataagacccccagggcctgggaaacgtaggaaaaggcccctaagtggagccggttgaggtgccgcttacttttcgaagcgttggtccggctgaccacggcggcgtcaaagccgatccccaagttatttaaaaagtagccgtcttcgtttttaatggcgtcgtgatagtggccaatggtgaccggttcggtagtttcggcatccaaaatttggtgcagggcggttaacgggttggttgagattccgtaaccacgggcgaaatcgttaccggttccgcaggggatgtagccaattggcagtgggtgttgccgaccgtttttgctctgcaagaccccgttaaccacttggtgtaaggtaccatcgccaccgatgacgatcagggtttcgtcgggccggccggcatgccggtcggccaggcgcatcgtgaggtaggtggctccttcctcgtccctggtaaataacggggtgtagtcgagttgggctgcgtctaaggcagccttaacggttgaccatgttgaattcccccggcccccgccggccacggggttaataatgatcgagtaatgcatagtttcctccggatcatcaaaaaagtgggtgggaaataacctccgctgcaggtcgtatgactaagctaggacgaacggttggtgcgggacgcaccgttcttcggcctgcttaggcactggaactacggtcatttaccacatttctgtctaacattcgtgaatacaacaagaggccgggaaaaacagagttttttcccggcctccgttaaacgcgaacagatcggcgccgcagggttaattaccgtgggccgtttaacgcttaaaattcagttaactggaagtccgcgttgttttcttgttcgtaggccagtgccttttcatccaacagttcgataaattcaacgttgtagttggtgttttcttctactaacacgcgggcagcggcttcggaatcggcttccaggtatagggattgggtgttttcccgacgcggggtcgtgtttttacttggttggtaataaactttgaaagtcatgtcatgctcctattcatttgttcgtaaattttacctaactatgatagcacacttgcccgggactgtccttaaatttccaactgtgctatcctaagctaagaaaaggtttagaaagtggggagtgcgatgaccctaatttggagtatcctgattgccttcgtagtggtggtcgtaatttatcaactggtgcaccggactttggtcaagcgcgccacgatcatcatgcaaaaccaagcccaagcggccaccgatcaggccgtacaagccgccctaaaggcccacctccgcccggccaatttaccaaccgactcggtgatggtggccgacgtttggggaaagggcgtcatggcctttgagtacgtggtcgacatgccacagctaaacgtcgaagaacaagagtggctgaccaaagaaaatttaaccacggcccttgatcaggtgggggccccaacccccttggtgattacagactggtgggagtatgaacaccaactgcacgttgacgtagccaacttaatgaatgaagcaaccaaggaatacgtggccgacctagaaaaattagataaggcttagctggcggtaggtttttacggtagcttggtcaaattaaaaagcccgtcccgtgaagcgaaatcgcgagggcgggctttttgatttaaggtcataacgaattacgcccaattttaaccgaagaagacggttccttcgggggcctcaaacgggttgtccttgttaatgtgatcgtagaacagcaccccgtggaggtggtcaatttcgtgttggcaaacgatggcggggtagtgctttaagcggaccttgtgcgttttaccctggacgtcttggtacttgagggtgatccggtcgtgacgtggcacgtagccggcgatgtcgcgatcaacggagaggcaaccttcgccttccgttagcgcccccatttgtacggattcggaaatgatgaccgggttgatgatcacatccttaaaaatcggggtgtcgtcttcttcgtcgtcggatggcaccaagacggcggccatttgcttgctgacgttgacctggggagcggcaaggccaaccccggcccgcaacccgtacttttcggccagttcttcatcttggctgatttccaagtattccattaggtccttagccaattgttgttcttcttcggtcagtgggaaggacaccttggcggcgtaatcgcgtaggaccgttccctcctggtcgtctctgacaatgtctttcattaaaatcattggtggatcccccttgtctctaattactattttctagtttagcacaatcaaaaggggggacgacaataattacctccggggcaaatcatgttaaaatgagagcaaattgattaaaagggtgatgtaaatggcaataaacggtggaaactattcctacccattagacccaacgtggacggcggaagaactgatcgccgtgactaacttctaccgggtcgttgaggacgcctacgagacaggggtgcggcggcaacgggtcctagattgctaccaagcgtttaaaaaggtggtccctaccaaggcccaagaaaagcaacttggccgcgatttttaccgggtctcgggctaccagtgctacgacgtggtcaaggcggccaaagaaacgaccaaggggcaacttaagatcggggggtaaaggatgttagaaaaaattgatcaagccgttttggacttgttagatgaggtgcgtcaccggaccctcaaccggatgcaggcctcttatgacatcgatctaaagtcctcgtacaaggatttagtgaccacggtcgacaaggaaaacgaccagtacatttcgaccaggttacacgaaatcgacccgggaagccgggtggtttcggaagaggggtttggcgatgaagtggccaccctgactggccacgtctggattgtggacccgattgacgggacgatgaactttgttatgcaacacgccaatttctacatcatgattgccctctacgttgatggtaagcccactttgggttacatcatggacgtaattgacgggaccgtctaccacggcggtaagaagcggggcgtctttgaaaataaccggcgcctgacgagcccggccaataacggcttaaaggatagcttggtggccctcaattcagcgatgattttaaacaacgcccataacctgcgtgaggtggcccaccaatcccggggcctacggatgtacggggcggctggaatggaattagtttacgtcctcactggccagttgggcgcctacctttcctacttgcacccctgggacttggctgcgggccgggttttggcggaggcaatgggattagtggtcaaagcgattgacgcgccttccattgatgtgttatcatctaaccttgtattaatagcgacaaaacaagcggccaatgatgtcttagcccttgtcaactagccgataactgtgacctcggtcgcagtttttttaagagaaaaaagcggtaacgcttggaaacgaaaggaagataaatcttgaaaacacgtgacgatattcgcaacattgcgatcattgcccacgtcgaccacggtaagacgaccctggttaacgaaatgttgaagcaatcggataccctgccggaacactttgaaatccaggaccgggcaatggacaccaacgccattgaacgggaacgggggatcacgatcctctccaagaacacggccgttaagtacaatggctaccaaatcaacatccttgatacgccagggcacgccgacttcggtggtgaagtggaacgtgttatgaagatggtggacggtgtcttgttagttgtcgatgcctttgaagggacgatgccgcaaacccgcttcgttttaaagaaggccctggaacaacacctgacgccgatcgtggtgattaacaaggttgaccgtgaaggcgctcgcccggaagaagtggttgacgaagtgctcgacctcttcatcgaattaggggccgacgaagaccaactggacttcccagtagtttacgcctccgctatgaacgggacgacgtcattagacgctgacgttgccacccaagaacacacgatgaagccgttatttgacacgatcatcgacacgattccggcaccaatcgacaactccgacgaaccactccaattccaagtggcgatcctcgattacaacgacttcgttggtcggattgggatcggccgcgtagttcgtggtcaaatcaaggttggggaccaagttacggttatgaaactggacggctccaagcaaaacttccgcgttaccaagctcttcgggttcgttgggcttaagcgggtggaaattcaagaagctaagtccggtgacctgatcgccgtttccgggatggatgaaatcaacgttggtgaaacggtggttaacccagaacacccggacgccttaacgccgctgcggatcgacccgccgacgttgcaaatgaccttccggaccaacgactccccgtttgctggtcgcgaaggtgaattcgtgacttcccggcaactggaaagccgcctgaagtctgaattacacaccgacgtttccctgcgggttgacgacactgatgacccgggtgcttggaccgtttccgggcgtggggaattgcacttatcaatcctgattgaaacgatgcgtcgggaaggttacgaactggccgtttcccgtccgcaagttatctaccgcgaagtcgacggggttgaatgcgaaccgtttgaagaagttcaaatcgacacgccggatgaatacactggttcaatcattgactcgctttcccaacgtaaggggcaaatgaagaacatggaaccatccaacaacggccaaacccggttgatttttgaagttccatcccggggcttgatcggttactccaacgaattcatgagccaaaccaagggttacgggattatgagccacgtcttcaaggaatacgctccggtggttaagaactggaacccaggccgcaagaaggggaccttggtttcgatgaactctggcaaggccacgacctacgccatgatggggatcgaatcccgcgggacgctcctgattgacccagggacggaagtctacgaagggatgatcgttggtgaaaacagccgcgaaaacgacatcacggttaacatcaccaagggtaagaacctgaccaacgtccgggcagccggttccgacgacatggcccggatcaagacgccaacgcacttgtcccttgaagaatcccttgaattcttaaacgacgatgaatactgcgaaatcacgccggaaaacgttcgtttacgtaagcaaatcctggacactaacgcccgggaaaaggcggctaagcggcgcaaggcagccttgcgtgacaagtaattaataaggctttcttaacggccgtgacaacatcggattgtcacggccgtttggtgtataattagaccacgattgtcgtgaaaatggggtgaatttaagtttatgaaaaaccaagccaaacgccggttctccacttgggacccgtggctattagtgccctttttatccctgtgcgtattgggggtggtgatggtgtattcagccagtgcggtggttcgctaccagtccgaaagtggccccttctcctacctccgtaagcaggccatctttgctgtcttagggctgttggtgtttatgtttgtttcctcagttgatattaaaatgtttcgtagtccggggctcttaaaatactttgccatggcgatgtttttgtctttgatcggcgttaagctgtttggggcctcgatcaacggggcccaagggtggatcaatatagggggggtcttttcgatccaaccggccgaagtctgcaagctctttttgatcttatacttagctagtctctttaccgattaccgcgagcaccctaagtcgtttagcaagtacgcgtatgcctttccgatgacggtggcggctgttttgattgttttaatcgtcatccagcccgaccttgggggggcggcaatcaactcggcgattgtcttaatcctctttttgagtgccaagactaagtggaagggcggcgtaacggtcctcgtttcggtctttttaggggtcgtatttggaatgccctttgtctcggagctagccgttaaatacattcatggctacaaggccgcccgcttcgtcggctacctcaacccctttggctctacttccggggccggtagccagttggtaaactcctattacgccatttcaaacgggggtctgtttgggaaggggctggggaactcgattcaaaagatggggtacctaccggagccaaacaccgactttatcttggccgtgattgctgaggagttggggttaatcacggtgattttaattctgctggggctaggcatcattgtctgccggacgattcagattggggcccgggcgactaaccagtacgacacgctcatttgttacggggtggcaacctttatcctggtcgaagcctcctttaacatcggggcggtctgcggtctgttgccgatcactggggtgaccctccccttcatttcctacggggggtccagtatgttggtgctttgttttgccctcgggctggtctttaatgtctccaggaggcaacgggcccgccggtctgcccaacagagccaagtcaaggaaggggtgctcaatgcgaatgcctgatgaacaatttgaattggtaccccgccgggggctcgccgtctacattagcagccgccgggtgattcgggccctccgtcactacggccgggtccactacgtttccaagcgggcccactacgccattatctacgttgacgaggcgcaggtcgcagaaacgattgaacgattagagaagctgcataacgtcaagcgggtggtgccgtccgccttaccagatttagatccggacgtggccgaccttgcgtcgacgggactatacaaaacacacgatgaggatgattaacgatgagagttgtggcgggtgaataccgggggcgtaaattaagcgcggtgccaggaatggcaacgcggccaacgaccgacaaggtgaaagaagcggtgtttaacatcattggcccctactttgatgggggaacgtcactggacctgtacgccgggtcgggtggcctttcgatcgaaggggtgtcacgcgggattgaacgggccgtcttggttgaccgtcagctagcggcgatcaagacgatcaagaaaaacattgcgaccactaagcacgaggaccagtttgtggtgttaaaacaagacgccacgcgggccctgcacatgctacaaagtaagggtgaacactttgatctaatctacttggacccgccctatgcgaagcagcagatcgtaactgacctaacaaaaatggtagaattggacttgataaacccgggggcaatcgtggtggcggaaaccaaccaggaggctaacctttcagaacagctccccggcttttcctttaagcgacgccaagattacggcatcacggtggtgaccgtgtaccggtatgacggaaaggagtaagaatatgaaagttgcaatctttccggggagttttgatcccctaactcttggtcacttggatttaattaaacgggggagcgccctttttgaccacctggccgtggccgtgatgactaacaccagcaaggatgcctggttcacggtggatgagcgggttgcccaagttaaagaagcggttgccggcctggacaacgtttcggtgattaccgctacgggcttaaccgttgacctgatgaacaaaattggggcggattatttgatgcgcggggttagaaacgttgacgatttccgttacgaaaaagacatcgccgcaatgaatcactacctagacgaccaggtggaaacgatcatcttcttagcggaccctaagtaccaatacctctctagtagcctcttaaaagaggtcgccatgtcggggggcaacatcgccgccctcttgccggccaatatcaacgaggcgttgcaagcgcgcctggaaaaacggcaaatgaagcgggtaaaaaaagagaatgaagaagcaagataatcaaatactgcgccggattggggtaaccttagccttaattttatttgcctgttggttcttattttggccactcaacctctacatcgaaagtccggggtcggcggatagcctcaagagctacgtgacgatgaagaatcaccccgataagtacaaggggagctttatgatcacctcggtctacctccagcaggcccgcccggctacgtacttgtgggccaagttgaatccacatacttccattgaaagtgccgattcggtgaccggtggcgaaaactcggcgacctacaccaaggtccaagacttttatatgcaatcggcgatcaacgaagcaatcgccgtggcctaccgggctgccggccagcaatacaccaagaagtacctggggatttacgtcttatcggttcagagcaactcggagtttaaaaagcagatccaagttggcgacacgattaccaaggtgaacgggcgccactttgacaccgccgctggctaccaaaagtacattgccagccaaaaggtgggcgacaagctgacggtaacttacctccacaacgggaagcaaaaaacggccaccgaaccgttggtcaagatctcgaccggtaaaccaggaattgggatcatcttgaccgataacgtcaaggtgaccaccaagattccggtgtcggttaaccccgggcagttgggcgggccgtccggtgggttaatgtttagcctgcagatttacgagcagttgacccaacaagacctccgtcacgggcgaaagattgccggaacggggacgattggtgcggacggctccgttggtgagattggcgggatcgataaaaagatcatcgccgccaagaatgccggggcaacgatcttctttgccccctacgtgaaaccaaccaaggagatcctaaagtatgaagaaggccacaagactaactaccaactagcaaaggaaacggctaaaaagtatgccccgaacatgaaggtagttccggttcagacctttgaagacgcggttaactaccttaaaacccaccaataaaaaaacgatcaggttttttcgtgacctgatcgttttttttgcgtacttaggggtgaagggaggaattgacggtggaaaaattagtcgaacagctccaggccctgtgggaagagcaccgttcacaaatctacgttgtcatcggcttggtgctagcagtgggtttttggtggtggcatacccaccaaccggttaccgacgcggtaggggcgactagccagtcgagcgcctattcggcaaccagtgcggtgaccagtagcctagcaactagtaccgaaaacggctcggggcgggtgtgggtggacgtaaagggggccgttaataagccaggggtttaccacttgaaaaagggggcccgggtgcaagaggccatcgctgcggcggggagtcagacgtcgttagccgacttaaaccaggttaacttagctaaggagctccaagaccaacaggtcgtgtacgtaccggcccaaggagaaaaagtggcggatgcgacgacggcgaccaccgggactacggacgccacgagcgctacgagccaaagcggtcagggtgattcggttaacctaaacacggcgactaaagagcagctgcaaacaatcgatgggattggtgacaaaaaggcggataagatcattgcctaccggcaggaacacggcggtttcaagacggtcgaggacttgaaaaacgttgacggctttggcgataaaacggtggccaaaataaaagaccggctggcggtttaggcatgacccagaaagtttgctatactagtgggtgacacttaagggggtatcaaaatgaaaaaaagaattgattgggaccagtacttcatggttcaagccgccctgttggcatcccggagcacttgcacccgcttgtcggtgggggccgtgttggttcgcgacaaacggatcatcggctccggctataacggggcggtggctggtgatgagcactgcatcgacgtcggttgttacctgcgcgatggtcactgtgtgcggacgatccacgcggaaatgaatgcccttttgcagtgcgccaagtttggcacctcgacggacggggcgatggtctacgtgactgacttcccgtgcttgcagtgcacgaagagcctcttacaagccgggatcacccaaatcaattacctccgtaattaccataacgatgattacgctatgaagttgattgagctaaagggcgtcacccttcaccaaatcaaactagacgcagatatcttagaccaggttaacctcgaccaatacattaacccggactaaatggcttctttgcggggcctgttcttggcccttgctgcttccctgaccgccgcttggttaatcggccaccaaaactgggccgcggtggggttgcttcttttattcggccgggtactttgccagcgcgaccgccggacaacttggctgacggttggggtgatcgtgatcatcggtttacggtgtgggcagctacttgctcagcgccaggcacaaacgcagccggctggcgactttacggggcaactaacggttcagcccgacgcctggcgaattaacggtgacctggcttcggcggttgccgttaccgaaagcgggtctaaggtgcaactcttcttaaccctccagagtcaggaccaacaacgtcaacttcaagaggtgactaccccggtaaagctgaacgtcaccggtaaggtggaacaaatcttaccggcaactaacaccaacgaatttgatcgaagggcctaccaggccaaccggggaatttataaccaggtgaccgggaaagccccggtcttggtagcccaagcgtcacaccgcctaacggactttctgcaccagttgcgggccaactttagtcaccacatggctaatttaccccagccgctagcggggtactgccggcggctgttgattggtgaacaggatccggcgaccgccagtgagatggtagcggtcaagcaactggggatcatccacctgttttgcctgtcgggtttacacctggtggttttgtgcggggtggtccgcggtttgtttgcacgcctaggcttgactaaggaaaccagccgggggttattgttaatcctcttgcccctctactgggtagtggggggcggttcggtaagcctggggcgggccagcatgatgatggagctacagttattaggacagttggttggcctacggggaatgctcccttgggcgatcagtttgttaattcaaaccctcatcagtccgagtatcctcttgtcaatggggggccagttgtcctacctgctatcgttttgcctgacctggtttgagcagcccagtggcctcaaacagaccctacgcctttctttggttagcttgccaccgctcttgcattcggtttaccaatttcacttactaagcctggtcatcaactacctgatgatcccctttttctcgctgatcatcatgcccctggcaattggcgggggaatcttgtacccactgtttccaggcttgggagcggtggtcaacgccggcctgatcttatttcaccgggggttggccgccttggctaaccttcccgggacgattacctttggcaaggtacctgcttgggtagcggtgagcttagttttattaacgatggtgacttgggaaaagcggggcgccgttaagtggctggttctcggctacgttgtcacctttgtgtggctccattttcccctacaaggtgaggtcaccttcgtcgacattggtcagggtgattgcattatcatccgtgaacccttcaaccggcgggtgatgatgattgataccgggggtaaacttaactttcaaacggaggggtggaagaaacgaactaattcggccactgataaggccaccagcacctctttaaattacctcaaaagcgagggaattgatcacttggacgcggtgtggctgtcgcacagtgatgcggaccacattggctacctaccaacggtattaaccagcatgcgggtggagcgcctctacgtcccagcgggaatggaaaagatgaccaagtttaccaagcggttgccgagcaacactaggacccagattataccgattaccagtcaagcgccgggctttggtggccttaccatcctgcacccgtttacgccgggggaggccaccaacgatgattcggtcgtcttggctggcgagtttggcggtaagcggtttgtgtttactggcgaccttccccaagctggggaattagctgttttggcgcattacccgaatttaagggcaacggtggttaagcttggccaccacggcagcaagacctccagttcgccgacctttttaaagcaggtgggcgcccgggtggggatcatatctgccgggcgcaataaccggtacgggcaccccaaccaagagacgttaacgaccctcgcgcaattacacatccaaacctattcaacgcaaacccaagggatgattacgtatcggtacaattcccggggtgggcactttattacccataacactcctgaacaacttcaattgagcaactgacagaaagcggtgatgacgtggacattcaagaactgagtaaacaactaaagcgggccaaccccgccatggtgtacctagtgttgggtacgcaagcggtcttgcaacgggaggccaaagacgtctttttaaacctgatcccagaagaagagcgggtcatgaacgtcggtagctacgacatggaaaccacccccttggctgacgccttagatgatgcaatggcggcgcccttttttggggagcggcggctagtcattttgaataagccggcctttttgactggtgggactagccgcggggcgcttaaacaagacggtgaggtgctccgtgagtacttaaagcacccccagccaacaacggtgctagttttgttggccccctacgaaaagctcgatggccgcaagggggtggtcaaggaccttaagaagttggcggtcgaggtttcggcggcgcccttagacgaaccccgggcccgtcgccttgttgaacagcggtttcaagcggatggttaccaactcgggcggggagccattgatgaactcgttcgccgtaccaacgccgattacggaaagatgatggccgccgtgccggtgattgaactagcggtttaccaagataagcgggtgactgatgcggccgtggccggtttagtcccccaatcactggacgaaaacgtctttgacctggttcaggcggtgttaaatcgtgagcaggtggaggccgttcgtttgtaccgggagctattagaaagccagcaggcccccttacaaatcaacgccattttagttagtcagttccgcttgctcttgcaaattaaggtgttgagcaaccggggccttagccaggggacgctagcgggtcagttaaaggttcacccgtaccgggttaaattaggcttacaaacggcccggcgctttagcatggatgacctgtcccacgcatacttagggctgatccgttgtgagcgggcgttaaagtcgactcaacaggatccggagttattattccaactcttcttactccagtacaccaagcaaaaggtttcctgatgaggagagtggccaaggacttctgaggcaggtcggatgtaagcgtggacgagcgacctgcgtagtccggaccgatccgcgtcctgtagttattggtcgagttttaggcacgacgctaaatcttgtcggtggattgccatggtggtgattcgtcggcaggattttttaagttttggggcacaaaaaaacgcccccgccaaattggcagggacgtttttcttttattggctaaccgcgcttactttgcgtaacgggcggaaagacgtgacttgtcacgtgcagccttgttcgccttgatcaggcccttagagtgggcatggtcgatagcggaaatagcggccttgtataagtcgtcaaggttgtcagcacctgctaacttagccttgtcaaacttcttgatggcagtccgcattgcgctcatttgggaagcgttccgggcagcggccttttcatttacacgtacacgttcaatcgctgacttgataattggcatttcgatttcacctccgtcaccgtttggtatcagttgaccagaattttcaacttttttattatagcgaatctcacttttgaatgcaactaccagctagaagaagattccgacttgcaattggaggcaaagttaagtatagtggttaaggttatttaaccaagcttaacccccactcggtttgacgatcctcaccgacgtcttacctagtggcgggtcttccaaaatttgaaaggtgggaaacattcatggctatctcaaaggaaaagaagaacgaaatcatcaagcaattcgctactcacgaaggggacactggttcaacccaagttcaagtggctgttttgactgcagacattaacgaactcaacgaacaccttcgcgaacacaagcacgattaccactcacaacgtggtttgatgaagaagatcggtcaccgtcgtaacctgttggcttacctccgtcggactgaccttcctgcttaccgggaactgatcaaggcccttggtcttcgtcggtaattattttccagggtgcccagtttactgggggccattaatgaagatcgtaacggtttcgttgcggtctttttattttgacttttcacttgctaacgagtattcttatgagagatcgattagagattaatgaaaactaattgatgaggggaaatacatatgtttagcgagattggccaaacaatttttgaaagcgggcaaggaaacacgttcttttaaggacgtgatgaattgcctttttttgtgcccttagggcacattatcgaaccgtaatgtaatataattattggtatgaaagatacaaaaataattacatatggtagaacatcgagagtgtcaagaatgttgtgtaaaaaaggaaacttcgtccgcatgaattggcaattctaaaacatcgaatcaagcgtgtcgtgacagtccttgaatccccgatgtgctcgattctcaaatttatcgttgtactccatcacttgcgtcatgataaagcgatcgagggctccttcgtttgggaactgctctttacgtcggaccatcttcttcaggctcttattgaacgactcaattaggttcgtcgagtagatggtctgacggatcgcagttggaaaactgaagaacgtgaatagctcctccatttggactagattcttgattcgacgcttataactggactcccacttagcactgaaagccgccaatcgttctttggcggcttgtaggttctctgcttgccgaatagccttaaagtcggtgataatctccctgcgatcgttcttgcgaacgtaccctaaaaggttgcgctctgcgtggacccagcaccgttgaaactttgcctgcgggtagttagcctcaatcgcagattgaagtccaactaaaccgtcggcgatgaacaactgaatatctttaatcccccgtgcgcgtaatccctggagtagttcagaccaagcggctccgttctcggtcggtgcgatactgtagtcaagaacttccttaccgccgtcacttcgaattccgatcgctacgttaacggcttctcgttcaacggtaccacggcgtaacggaatgtaagtagcatcgaggaacacacagacgtactgtgagtacttgaatttgcgctcgtggaactcttcaaccaggtgttccgtccgcttagtgatgtttgaaaccgtggttggtgagtagtagtggccgtacattctctcaaccatatcagcgatttcacgagttgtgacgcccttggagtacatcttgatgaccatttcctccagtccatcagtccgacgcacgtaaggagggaagagggcgttttgaaacttgtttaaccggtcccgtgggatcgtcagattaatttcaccgtactcagtgtcgatcgtgcgggtgtacgtcccgttccggtagttcacgtcgtcttttgatcggtcgatccgagtatgtggttcgtagcctagcactgcagtcagttcattttgaaggaactgattagcggccacttcaatttgacgacgtaagacttcattcagggtaatatctttgtcggaagatagcgctgcgataatatctttgttaaactgattcatggggaaagcctccgtattctgattggtttttggcgatttcaatcatacggggaaggctttccctttttcaataccctcaaggtatcaatttacacaaaatattttacactcccagaacatcagtctacaatcttaattatcatttaatttggggaactaaatatcgtgataaagtgttgaaaggacacgtagaagaagtcttgaagcaatcattatatgatatagcttcaaaatatggatttacgattgctcatatggagattggtaaagatgaccatatccacttactagtgagcgctccgccaaaactgtctgtaactaacatcatgcgctggcttaaaggcatttctgcacggcacctcttccgagaatgtccagaactacaaactagctactggaaaaagcaaggtcgtcacctatggtcaccaagttattatgttgaaagcattgggagcgttaatgaacaagcagtagccaagtatattgatgatcaacgcaaaaaggaggtgaaattagaatgaccaaattaattaaaggggtcaagctacgcttgtaccctaacaagcaacaacaagctcaactatggcaaatgttcggcaatgaccgtagagtgtggaatctcatgctagatatggctaagcaacgctatcaaaataatcctagcagtcattttgtaaatgaatatggaatgaattacttgcttaaacagttgaaacaagaatatccctatctcaaagacagcgatgcgactagtttccttgtggttaaccataatctagtccaagcttttaagatgctgtttaaacatcgtggtggctatccacgctttaaaagcaggcacgccgccaaacagtcatatactggtcggtcggtctgcacagtgattgccaagagaagaatgaaactacctaagttaggaagcattcgaactagtaagacctctcaagctgtaaatggcaaaattaagcgttataccgtcagctatggtccaactggtcgctactacttatctttgcaggtcgagactgttgctccagaagcattgccaaaaacaggcaagaccgttggcctggatgttgggatcgctgacttagcgattagttctgacggtgaaaagtttggtactttcaatgctaagtggttggaaaatcaagccacaaagtggcaaagcaagtatagtcgccgaaaatatcaagcaaccgtagctgtttgccaatggaaccataatcataaagacgtaaaaatggatctcaatgattatcagaattggcaacgggctcaaaaacaaaaggctcgctaccaacaacggatagcgaaccaacgtcaagattacttacacaaactaacaacagccttagttaaaaaatacgatgtgattgtcattgaagatttgaaagccaagaatctacaaaagaatcaccatttagctaaagctattgcgaatgccagttggtaccaatttagaaccatgctggaatacaagtgtgattggtacggtaaacagttaattactgttaatcctaattacaccagtcagatctgtagcacgtgtggttaccatagtgggaagaaaccacttgaaattagagaatggacttgtcctaaatgtggtactcatcacgatcgagatattaatgcggcagttaatatactccatagaggattaaaagccgttggctagggactagccgtggtaaaagaacggagttctgtaagttaggtattctgaatacagaagcaacatcctaaatactacttcgtgttcccagaagctcggtcatttatggccgagtagttcacagaacgactagagctctttgccagtcagcttcagttggggccggagtacttagaggtcttagaggacatgaccgaccgggtcaaccgccctgacttaaccccgagtgggcagatggcgcggttcattaaagacggctcactgaccgaattcgggttacgccgggccttgcgttaccaaaagagcgccctgcaatccctggctacgtttaaggggtttgaaaacatgaccaccccgctgtcggcagaggacctaaagaaaaacctcttccggggcagttacgaaccaagtggcttaattcaatgataatagacgcctgtccggtgacccgggcggacgtctttaactttgtcgccctaatttacgatctgtggtaagatgaatagtaatgatttgtgagtgaaaaaagagcccattagacaaccggtcggatggggcatttacaagtaaatattgaacaaattaaaggagaagccatgagcaagattaagattattccttttggcggggtccgcgaaaacgggaagaacatgtacgccgtggaagtggacggccatatttttattctcgactgtgggttaaaatacccggaaaacgaactgatggggatcgacgtggtcattccggactggtcgtacctacaagaccacgctgaccaaattaagggggtctttttaacccacggtcacgccgacgccattggggcactgccgtactttttagccgactttaaggtgccggtgtacgggtcccagttgacgatcgccctcgctaagttggcggttaaggaaaacaagcaggttaagaagtttaacgatttccacgtggttgacgaaactaagaccatcaaatttggtaacgttacgatcggctttttcaccacgacccacatcattccggatacattggggattgacgttcagacgccggaagggtcgatcgtttacaccggggactttaagtttgaccaaaccgccgttaagggttaccagaccaacttggctcggttagccgaagtcggaaccgaaggggtgctggccttgctcagtgattcagctggggcgggaattaccggcgcttcgaccagggaacgtgacatccgcgcctacatcaaagacacctttgaaaacaccaagggccggatcgtggttgcatcggtggcttccaacatcatgcggatccaacagattgttgacgcggcactggccaccgaccgcaaaatcgtgttgtccggcgaggacctcgagcagatcatcgagacggcggaggggctcaacttgctccaaattccggacgatacgttgatctcctttgaagaggccttggaccttgatgacgaccaagtggtgattctagtcaccggacggatgggcgaacccaccaagtccttgcaacagatcgccaatggtgacgacccagacatccagctgaccagcaccgacctggtttttgtgaccaccacgccgtcgtacgcgatcgaaacaatggtccaaaagaccaaggatatgctttaccgggcgggggccgaggttaagtttatcgccgatgacttaaacccgtctggccaagccagtcaaaatgacgagcaactaatgctgaacttcatgaagccgaagttctttattccgatccaaggggaataccggctgcttgaccggcacgccgaactggctgaagaagtcggcatcccggccgaaaacatcttcattaccgctaagggggacgttctctcctatgaagatggcaagttccacctgggggaccgggttgaagttggcaacacgatgattgacggaaccggggttggtgacatcggtaacatcgtcttacgcgaccggcgggtcctttccgaagacggaatcttcgtcgtggtggctacgattgaccgcaagaagaaaaagatcgtcgcccgtccgcagatcacatcacggggctttgtcttcgtgaagactaaccgtgagttgatgaaccaagcggccgacctggtcgaaaaggtggtccaagaagacctcgaccaaaaggaattcgattggggacacctgaagcaaaacgttcgcgacaaactgaaccgcttcttattcaaccaaaccaagcgtcacccggtgatcctgccggtgatcatggaaatcaaccagcaccccaagcgtaagaaccacactaaggcgaccaaggaagctaccaaggcaccggtggccaagaaaccggccaaaaagcaccacaattcccgtggtggtcgggggcggggtaagaagcgtccggcgagcgaagcaaagtaattaagtaaccaattaaacagatgggcttctagttgttcaattacgaacggtactaggagccccttctttatctgcaagaaggagggcactatgacaccggaacaaggagcacgatttaagcaggccacccaagcaatcgatcaggggcaatttggtgaggggattcggctgttgcaagagcttgatttagaggtcgatgactttgccgtcaaccgccagttagcccgggcactgtttgaagaccaacgctttgtcgaggcctaccaggtcgctgaacgccacttggccgattatgaccaatcccgtcaactagcggacttttacgtccagttggcccttaaaaaccaactgtttatccccgcccgccaattcatcagtttggcgacccacttaacggatgcggaggggcgcctggtcaaacgggccgaagaacaatatgaccgggtgggggcgcagaccttagcgagtcggcgccgccaatttatccacatgggggattgtagctttcatgaacaacagcgccgctttagcgaggggcggatgctcccgctcagcgattacttggtgggggctaagttcttactgcgtgacccggatacccacccgttgatcaaatcatcactggtgcaggtcctccaacagctacggcttaacgaagagctcacggtgctctggcttgatgaaaaagagcaccctttaaacatcaaggagctcaagccgctgggtgaactgaccgtcgtcaaggagggggaacggttaattgccgcccgcttcgctgatcaagacccgctctcgtatcaaacctacctgcgagaattccacctgcaactggcctttttgtacccctttgtggagttagcaattgaagatcctgacgcttgggtgcaggccttggtggcgtattcggcaagcggaaatgaggagccaatcttgcgtgcacaccagtggcaggagcggattaacgcactagtgacaaggcttagttgaatttagctaaattcgtttacaaatgctaactgatctgataccattattaagaattcttcgccggaactgattttatcctttaaattggtttggcggagtagtacaattaatctaaaggtgtgtcagaacacccctggtggtctggcatgttacttgtaatttttcaggagggtttcattaatggcagaaaaagaacattatgaacgtactaagccccacgttaacatcggtactattggccacgttgaccacgggaagactactttaaccgcagctatcaccaaggtattggccgctaagggccttgccaaggcagaagactactctgatatcgatgctgctccagaagaaaaggaacgtggtatcactatcaacactgcccacgttgaatacgaaacggaaaagcgtcactacgctcacatcgacgctccagggcacgccgactacgttaagaacatgatcactggggccgctcaaatggacggtgcgatcttagttgttgccgcaactgatggtccgatgccacaaactcgtgaacacatccttctggctcgccaggtcggtgttgaatacatcgttgtcttccttaacaagactgaccttgttgacgatgacgaactggttgacttagttgaaatggaagttcgtgaccttctgtccgaatacgacttccctggcgatgatgttccggttgttcgtgggtccgctcttaaggccctcgaaggtgacccagaacaagaacaagttgttcttcaccttctggacgtcgttgacgaatacatcccaactccaaagcgtcctactgacaagccattcatgatgcctgtcgaagacgtcttcactatcactggtcgtggtactgttgcttctggtcgtatcgaccgtggtactgttaagatcggtgacgaagttgaaatcgttggtctgaaggaagacgttatcaagaccactgttaccggtgttgaaatgttccacaagacccttgatcttggggaagccggggacaacgttggtatccttttacgtggggtttctcacgaccaaatcgaacgtggtcaagttctggcagaaccaggctccatccaaacgcacaagcaattcaagggtgaagtctacgttatgaccaaggaagaagggggccgtcacacgccattcttctccaactaccgcccacaattctacttccacactactgacgttactggtaccattgaactcccagatggtgttgaaatggttatgcctggtgacaacgttaccttcactgttgaactgcaaaagccagttgcccttgaaaagggtctgaagttcaccatccgtgaaggtggtcacactgttggtgccggtgtggtatccgaagtgctcgactaatctcgggaattaacttctaaaagagtcgcgatttatcgcggctttttttattggcggactactgggatttttaattgaaatacccccctttctagggtagaattaaaaagtatgtaggactctcgccaattgacgggaggctaaatagatatgttattggaggaaatgaaatgtcagtaaaatgggaacgcgatagcgacgctccaaaggggacgttaacgttcgatatcgacactgaaaccattcaaaaggggattgaccacgcctttacccgcacccaaaagcggatttcggttcctggcttccgtaagggccacgttccgcggacgatcttcaaccaaatgtacggggaagaatccctctaccaagatgctttaaacgacgtcttaccggatgcttacgaagccgccatcaaggaagcgggcatcgaaccggtcgaccaaccacaagttaacgttgaaagcatggaaaagggtcaaccttggaccttgacggccactgtggcggttaagccagaagtaaccttgggcgactacaaggggatggaagttcctgaacaagacacttccgtttccgacgccgacgttgacagcgaattagaaaacaagcgtcaacaacaagcagaactggtgcttaaggaagacgaagcagctgccgacggcgacaccgttgtcatcgactacgaaggctccgtagacggggaaaagtttgatggcggttccgctgataactactccttagttctgggttctggctcctttatcccgggctttgaagaccaattagttggccacaaggcgggcgaagacgtggacgttaacgttaccttcccagaagactaccacgctaaggacttagctggtaaggacgccctcttcaaggttaagatccacgaagttaaggaaaagcaacttccggaactggacgatgaatttgctaaggacgtcgacgaagacgttgaaaccctggccgaattaaaggacaaggttaaaaagcaactccaagaccaaaaggaagccgctgctaaggcagccatcgaagacgctgcgattgaagcagccgttgccaacgccgaaacggaagaaattccgcaagccatgttagacgatgacactaaccgtcaactccaacaatacttggccggcatgcaacaacaagggatcaacccacaaatgtacttccaaatcaccaacacgacggaagacgacctgcgcaagcaatttgctgacgacgcagctaagcgggtgaagaccaacttagtattggaagccgttgtaaaggatgctaacctaaacgctactgacgaagacgttcaaaacgaaatcgctgacctggcaaagcaatacgggatggacgaagaagccgtatccaaggctttgacccgcgacatgctggaacacgatatcgaaatcaagaaggccgttgacctgattgcggattccgcaaagcaaaccgccaaggccgctgacaaggactaatcatttaccgtgattaatctttacccaaagggggagtcgcaacagccatgcttgttgcgaccctcctttttaattggtagcttaattattttaaaacgcagcgtacgtctgttatgattatcctatcgattaccattaggaggtaagtaaatgtttgaagataccactggacaagatgtccactgttctttttgtgggaagtcccagtcggaagtgcaaaagatcgttgccggtcccggcgtgttcatctgtaatgaatgcgtggccctgtgccaagaaatcattgaccaggagctagccgaggaccgcacggaagcagaaacgttcaccgttccgaccccgcaagaaattttaaatcaattagatgactacgtaattggtcaacaagacgctaagaagaccctcgccgtagccgtatacaaccactacaagcgggttaacgccatggtgaccggtgataataacgataccgaattacaaaagtctaacatcgccgtgatcgggccgaccgggtccgggaagacctacttggcccaatcgctggcccggatcctaaacgtgccgttcgccattgccgacgccaccaccctgaccgaagcgggttacgtaggggaagacgttgaaaatatcatcttaaagctcctccaagctgccgattttgatatcgaccgggccgaaaaggggatcatctacatcgatgaaatcgataagatcgccaagaagagcgaaaatgtttcaatcacccgggacgtctccggggaaggggttcaacaggccctcttaaagattctggaaggcacgatcgccaacgttccgccgcagggtggtcgtaagcacccgcaacaagagttcattcaggtggacaccaagaacatcctcttcattgtcgggggagcctttgacgggattgaaacgatcgtcaaggaacgcttaggggataagacgatcgggtttgggaccgactccaaggaaattaacgacgtgactgaaaagaatatcttacaacacgtcattccagaagacctactgaagtttgggctgatccctgaatttatcgggcgcctcccagtcatgaccgccttagaaaagcttgatgaagccgacttagtgcggatcctgacggaaccaaagaacgccctggttaagcagtaccaagaactgatccgcttagacggggcggaactacacttcacggcgggggccctgcaagcaatggctaagatggcgattgaccggaacacgggtgcccgggggctgcgttcgatcattgaagacgtgatgcgcgacatcatgtttgacttaccaagccgccaggacgtggttaaggtggtcatcaataaggaatgcgtcaccaagcacaccgccccagaatacgtgttgcaaagcgaccaagcatcctaggcgaggaagacgaatgcaagtacatgatgttgaattaacgatctcggcggtcgaagaaaaccagtacccagccacggccctgccggagttagccctggtcggccgctccaacgttgggaagtcttcgttgaccaacgtgttgattaaccggaaaaactacgcccacacctcgggccaacctgggaagacccagaccctgaacttctatgaggttgaacacaagctttactttgtcgacgtgcccggttacggctacgccaaggtctccaagaagcagcgggaaaagtttggtaagatgatcgaaaactacctgaccacccgcgaacaactgcgcggagtcgtccaattagttgacgggcgccacgccccgacggaagacgaccggatgatgtttcagtggttagcctactaccacatcccgaccctggtggtggccaccaaggttgacaaggtcaagcccaacgcccataaccggatcgtcaaggtcgtcaaagagggcctgggcgccgcaaaggatcaggacttaatcctcttttcggcgacaactaaaaagggcgccgagtcggtttggcagtggattgaagaacggacgggagtaagtgactaatggagtttaatgactatcaaaaagcggccaaaagaacccgctacggcaacgaacaggtactgactaactgtgccctgggcctagcgggcgaggccggtcaggtggttgacctggtcaaaaattacacctttaagggtcaccccttggataaggaccagttgacccacgagttaggtgatgtcttatggtacctgtcccaaattgccgaatgggccgatattcccttcgatcaggtggccaaggataatattgaaaccttgaaccgccgttacccaaacggctttaataaacaggcctagggtgggaagccctactttgtgtacggtaccttaaaaatgatgaaaggggctgggagatgcgttctcccagcccctttttcgattgaggccgggaaaaaactccgttttccccggcctcttgctgtattcccgaatgttagacagaaaacgtggtcaataaccgcaggcctagtgtctaagcaggccgaagaacggtgcgtaccgcaccaaccgttcgtcctagcttagtcatacggcctgccgagtaggttatttcccacccacttttacttggcggaaccttcttttttagcggcgtcttctttggcgtcctttggttggtcgtccggttttttaaccggcttgagcgggtcgctagcgaacttattgaataagtcgtccagcttatcgctgcggcgagtgacaagtcccattaggcatcctcctttgtggtgctaaattagggctattttagcacagatgccggatgaaaaaaagcaaagcggcgccgctttgttatgcataaatcgggaaaaacggggatttatatgcgatttacttgcataataattcgttagttagtataatgggttcattatcaacagagacgagggagcaacgatggaagataaaacaatgattgaaattaaggacctcaagaagtccttcggtaaaaacatcatcttagacggggttaacgaagaggtcaaaaagggccaggtgatctgcgtgattgggccgtccggggccgggaagagtaccttcttacggtgtttgaacctgctagaagaaccgagtgcgggcgccgtgttatttgaggggcaaaacctggttgagatgggggccaaggaagttcaaaccgtccgcgaaaagatggggatggttttccaaggcttcaacctctttcctaacatgaccgtgttagacaacgtaaccctcgccccaattaaggttaaggggatggacaaggaacaagcacaaaagctgggacaccaactgttaagcgaagtggacatggacgataaggctgatgcctacccactgtccttatccggggggcaaaagcagcgggtggccatcgcccgggcgctggcgatgaacccggaagtgatgctcttcgatgaaccaaccagcgccctggacccggaaatggtgggggaagtgctcaaagtaatgcaagagctagctaacaacgggatgacgatggtcgtggtgacccacgaaatgggcttcgccaagaacgtggccgatgaaatctggttcatggccgacgggaacatccaagaggtggccagcccccaagaattctttaccaaccccaagactgagcgggcccaggacttcttggaaaagatattgaatgcgtaattaaaggaagtgcgggccaaccattaagcaggccgtgggctaaggaaaggttgggggttgatgcggcacgcatcgttctccggccagacttagccactaagctaggacaggggtaaattgcacgttgctttaaataaacatccggtcgcttcgcaaagtacttgcgaaggaccggatgtttatttgcagggagcggtagcacggccttttctttgcccccgccccccaaaagccgtaaaatagatttatcaaacacctgtttaaagggggaacgagattggcaagtgagtacttagaacacaagctggccctcttgccggaccagccgggctgctacttaatgaaaaacgccaacgcccagatcatttacgtcggcaaggccaaaaacttaaagaaccgggtgcggtcctacttcaagtctagtcacacggggaaggtggcggcgatggtcgaagaagtggccgacttcgaaacgatcgtcacctcctccaataaggaatcctttttgttggagatcaccctgattcaaaaacaccaaccctactacaacattaagcttaagcgggggacggggtatccctacatcaaaatcaccaacgagcgcgacccgatcattaagattaccggccaagtcaaaaaagacggcgcctactactttggcccctaccctaacgtctacgcggccgaagaaacggttcacttcattcaaaaggtctttcccttacgccggtgccatggctaccaggggcggccgtgcctgtattaccacctcggccagtgcctggggtgttgctttaaggaagtaccggaagaagaatacgccgttcaaactaagcggattaagtcctttttaaatggcaataccgcccaggtgaaaaagcagttgaccgcccggatggagcgggctgccgggcagctcgaatttgaacgggcggccgagattcgcgaccagctccactacattgaagtaacggtcgaaaaacaaaagatcatttcaaacgataagaccccccgcgacctctttaacttttacttggacaagggctggctaagtatccaggtcttcttcattcgccaggcccggttaatgaagcgtgaaaaacggctcttcccggtggtcgatacggccgaagaggaaatgacttcctttatcctccagttctacaaccggcgcaacaagttgttgccaaaggaaatcctcttgccggagggattaccgaaccaagaaatcgaggagatcttaggggtgccggtgcgggccccccagcgcggggagaaacgcgacctgctggacatggctaaggaaaacgccatcctgtctttaaacgaaaagttccgcctgctggaaatggaccgccagaaaacgaccggggcgatgaaagagatcaccgacgaactgggcctgccaaccggccacgtgatcgaagccttcgaccactcccacattcagggggccgatccggtctcggcgatggtggtctttgtcaacggtgaaccggctaaaaagctgtaccgcaagtacaagctaaccaccgtcgttgaccacgccgacgaagccgcttcgacgcgcgaagtgatctttcggcgctactcccggctcctaaaggaagaaaagccgatgccggacatgatcatgatggacgggggaccgattcaaatggaggcggccaaggacgtcttggaaaaccaactcggcttaaacattccggtgatcgggatggtcaaaaacgataagcaccagactgccgacctcttgtacggcgacgatgcccaccacgtcaatttggacccgcgtagccagggcttttacctggtgcaacggattcaagacgaggtgcaccgcttcgccattacttaccaccgcaaggttcacaccaagcactccctgtcgtcgcggctcgatgagattcacggggtcggtccccggacccggagcaagctcttgaaggcctttggttcgattaataagattgccgtcgccccggtcgaagaaatcagggcgctcgggattaaccaaacaaccgcccagttaatcaaggtctctttgcaggggcaagccgaggtcaagaaggggtccagtcatgactagctttgacctgacggggcttttcccatatactagagaatgattgaattaagaacggagaagatagatgccaacatttgtggatcaaattaaaattgaagtacacgccggacacggcggtaacggaatggtggccttccgccgggaaaagtacgttcccaacggtggtccggccggcggtgacggcggtcggggtggctcgatcatcttaaaggtcgatgaaggcctgcggaccctgatggattttcgctaccaccggatttttaaggccaagaacggccaaaacgggatgagtaagcaaatgaccggggcggccgccgatgacacggtgatcgccgttccccaggggaccacggtccgcgatcttgacaccggtcagattgtcggcgacctggttgaacaaggccaagaactggttgtcgccaaggggggccgcggtggccggggcaacattcactttgcctcgccgaagaacccggccccggaaatcgccgaaaacggtgaaccgggcgaagaccactacctggagctcgaactgaagatgctggccgacgtcggtttaatcggtttcccgtcggtcggcaagtcgaccctgctttcggtggtgaccggcgccaagccaaagatcgccgcttacgagtttaccaccctagtgccgaacctcgggatggtaatgctaccggacgggcgtgacttcgccatggccgacatgccgggattgattaacggcgcctccaagggggtcgggctggggctccagttcctgcgccacatcgaacggacccgggtgctcttacacctggtggacctggggaatcaggacgccgaattggcgctcgagaagttccacgatattaacaaggaactggcttcttacgacccggaactcctcaagcggccgcaaattgtggtagccaccaagatggacctaccggaagctcaggagcacttggacgagtttaagaagctactggaagcggacgacaccctcccggagacgccgcaagtctttgcgatttcggcggtaactcacgccggggttcaggaactgatgcaaacgacggccaacctgattgaagaaacgccggcctttgacgccaacgcccacgatgaacaagaagccgtcacttacaaggcgccgcaagaagcggaaccagacttcacgattagccgggatgacgacgggacttgggtcctgagcggggccaagttggaacggctcttcgtgatgacgaacttggatcacgaagacagtcagctgcgctttgcccgtcaactgcgccacatgggggtcgatgacgccctacgcgaggccggcatccaagacggtgatttggtacggatcgaggactttgtctttgaattcgtccaataatttgatgattagaaagatggtttagaatgcagattgaatttttaggaactggggcggggtcgccaagtaagcaacggaacgtttcaagcctggccctgcgcctgttagaggaacgcaacgccatttggctctttgactgcggggaggcgacccaacaccagatcctgcacaccaccattcgcccccgcaaggtggaaaagattttcatcacccacctgcacggcgatcacatctttggtttgcccggcttcttgtcgtcgcgctcctttcagggcggcgacgaaccgctaaccatttacggacccaaggggattaaagactttgtgcaaaccgccctcaaggtgtcggaatcgcgcctgtcttacccactcaagttcgtggagctgactagcgatggcgaggtctttaaggaccaaaccttcaccgtgaccgcccggcggctggaccacaagattgccagctttggctaccgggtggaagaggcggcccaccctggtgaactgatggttgaaaaggtacgccaagctgggattccgtcggggccactgtacggccaactcaagcgcggtgaggtggtgaccctgccagacggccgcacggtcgatggccacgacttcatcggggcgccgcaaccgggccggatcgtcgctattttaggcgatacccgggtgaccgataacgccgttaagttagctaagggcgccgacgtcctagttcacgaggcgacctttgccaaaaacgagcaacgcttggcccacaactactaccactcaaccagcgcccaggcggccacggttgccaaaaaggcgggtgcccagcgcttattgctcaaccacatttcggcgcgttacgtcggcaggtacgccaatgagctggcctaccaagtgcgggacatttttgagcaaacccgggtggtgaatgatttagacgtcatcgagattccttttaaggaaaggtaaggaagcgagggtgaaggaccatgttaatgattaagcgactgaagcaactgcgttttttgcgtaacaaggtggttttgatcaccgggggttcggaggggatcggcaaggcgctggccctagaagccgcccggcgcggggccgtcgtggtggtggccgcccgcaaccaagaaaagcttcaagaggtagcggaccgctgcctgatcttagcggggcgcccgtcctttgcctttaaaatggatgtgaccgatcccgaccaggtggatgaggtccttgaccagattcgccaccaggtcggggaaattgacgttttgatcaatgccgccggcctcgggatgatggacgccgtggttgaccaaagctacgcgaccatgcacaagatggtgacggtcaacttcttggccgccatgtacctgagccggtgcgtggccaaacagatgatgaatcaagggtacggcgccattattaacgtcgcttcgttgggcggcaagatcccgacccctaactcggcggtttactcagccaccaaggcgggggtgatccagttctccaacatcttgcggatggaagttgccgactacggggtccaggtcctaaccgttaatccgggaccggtcgccaccgacttcttcaagaaggccgacccaagcggggaatacatggcccacctaccgcagtggtttgttatcgcaccggacgccttagcccgccaggtctgggacaacgtgggttacgaaacccgcgaaattaacgtaccgggctacacgactgggatcgcctgggcctaccagatcatcccgggcctcggggactgggcgatcaagaagttcttcaacttccaacaaaataagcataacctctaaagtaaatgactccagcagttcgtaaccgggtgctggggtcttaatactgttaagacttagaaaggaacgggcatgattgacagcaagtacgcctggcaagggcaagcaaacggcgataaagaaacgatccaggtggtggccgatgcgacggggctaccggcggagttagcggcccttttagtcaaccaggggattaaaagcgctgacgccgcccaacggtggctcaacccgcaagcagaagacctccacacccccgacgcgttgcacgacgtcgaccgggccgttgagcggatcatggcggcggtcgaagcgggcgaaaagatcacggtctacggtgattacgacgccgacgggatcaccgccaccactttgatgtacgaggcactggaaacgctgggggcgcaagttgattattacgtgcccgatcgtttcactgatggttacgggcccaatcaagcggtctaccagcggctgattgaggggggcacccagctaatcgtcaccgttgacaacggggtggccgggatggcggcgattgagtatgccaaggagcagggggttgacgtggtcattaccgaccaccacgccctgcccgaacaactcccgccggccgtggcgattgtccacccccagtacccgggtagcgagtatccctttgccgatctgtccggggtcggggtcgcctttgaagtggcctgggccctgctgggtgagttcccggtggaaatgctggacctggtggcgatcggggagttggccgacctggtttccctggccggcgaaaatcacgccctagtggcactggggttgcagcagctccgccaggggagccggccgggcttgcacgccctgctgaagttagccggggtcaaggaggcgacactgaccgggaccgacgtgggcttccaactagcgccgcgcttaaacgccctcggccggattgaacaggccggcccgggggtggtcctcttgtccacctttgacgaagaggaggccgaacggttagctaaagaagtcgaccaaaccaacgaggagcgtaagcaactggtggagcagatcactaaagaagccctcgcaatggcggctaaccaacaggtgcccgccctggtcttggtgggtcacggctggcaccagggggtgttagggatcgtggcggcccacgtggttcaagcaaccggtaagccaaccatcgtcgcttccgccaacgagggtgagacgatcgcgaagggctccggccgctcggtggagggcctcgatttgttcgccgccctggatcagcaccgcgacttgatgacggccttcgggggtcacgcaatggcctgcgggatgtcctttgaattaactgcggcagcgcccctacaagcggccttaaacgaagaggtcacggcgcagggctttaaccagcagcaaaaaccgccgttaaaaattaccctgaccttggcaccagatcggctcacccaggacctgtacacgcaaatccagcggttggcgccctttggcccgggcaacgaggagccccaaatcgaactcgacgtcaagggaccggtggcgacccaggtgatgggcaaggacaagtcccaccttaaactaaaggtcggtcaaccgccgttagacgtggtcgcctttggcaaggctagcctagcaccggccctggccgaggcggaagaagtcaaactggtcggcaccctcagcttaaacgagtggcggggcaagaccagctgccagctgatgctaaccgacgtggcggccaccggagtcaccgtgctcgaccaacggacggcccggctgttgccgccgatgtttgaaccggctgcggtttacctggccttcgatgagcggctgcgcaataacattaatggccacgctaacgggccggtggtcggccctaaggacctcaccgccgacctggtagccaaccaggaactggtagtggttgattgcccgccgatcattagccagctgaccacaagcttggctaagtgcgcggcggctagttcgatccgactcctgtgctacttcaaccaggcccccctgaccgggatgccagcctaccaggcctttgccaacctgtaccgcctgctaggtcaaaaccccaacataaacatcaaccagcaggtcaacccaattagtaactacctgcgcttgccagcggaccagttaattttcatgataaatgtgttttttgaggctggatttgttacaattaaagatggtgttttaaatctcgtcccgcaggctcagcggcgggaccttaaagaaacaacgagttatcgtcgccgccaggcgcaattagaagttgaacgggccctggtccattcgtctcaccccgatctagtggcgtgggtcaagcggctggttggcgcgcgctaaaggagaaatttttatggctattaatctttacgattacgtcgctagcattccggattaccccgaaaaagggatcgttttccgcgacatcttgccgctgatggcaaacggggaggccttcaagcaggccaccgatgaaattgccaactacgctcgcgacaagcacgttgacatggtggtcggtccagaggcccggggcttcatcgttggttgcccggttgcttacgaactcggggtcggctttgccccggcccgtaagaaggggaaactgccccggccggcagtctcttcgacttacgacctggaatacgggtcggcaaccctgcaaatggaaaatgattccatcaagccgggccaacgggtgctagtcgttgatgacctcttggctaccgggggcacgatttcggccaccatcgacatggttgaacaaatgggcgggatcgtggtcggttgtgccttcttgatcgacttaaaggacctaaacggccgcgaaaagctgaagggttatgacgttaagaccctgatggaattcgagggagaatagttgagtgcgatccagccatcaggcagaccgtgggctaaggataggacgggggttgatgcggtacgcatcgttctccggccagacttagccactaggtctgcggctgggagcacgttatcagtgctgccgttgcgacccaaccattggctaggcacgcatcccatgtaaaacttaaccagcgccgaggagaaaagtcgttttttccctcggcgctttttgcattcaagtaattgatcaccaaaactgatcaattcgatcgccaaccggaattggcaagtgaccgtccaacagcgataatgggggaaagtcattttgattaaggaggagcgccatgacgagaagcgatgaagaagcggtggtggaaatttaccgggccgaaaaccgggcgatggttgaacgcgaccaggccaccctcgaacggatcctggcggaaacgatgaccttgacccacatgaccggttacgttcagccccgccaggagtggatcgcccagataatggacgggaaaatgaagtattattcttcaaccgaggagcgagtctttgacgtggtggttgaaggggaccaggccagcctagtgggccaaaaccgggtcaaagcaagtgtttggggcggcggggttagtacctggcccctgcaaatgcgagtcaacttgaaacgtcaggctgggcgttgtcagattgtcagccaggtggccagtacttactaatctgaaccggtaatgctcagtccgaaaccataaaaaagcaccgctcacgaatgggcggtgcttttttgctaggctattattaaccaaccttaactggggtttcaggttcttcacccttaaccagggccaggttgttgtcgaaggcctttaataccatgttgcgaactgcgtgcgtagtgtagaaggcggtgtgaggcgttaccaagacgttgtcgcggtggatcaagtcgttaaggcgggcgtcagggaattccttaccttgccagtcttcgttgaagatccccacttcgtcttcgtaagtatccatgacaaaaccgaacagcttgccggagtccagggcacggataacggcgtcggtgtcaaccaacggaccacgagaaacgttaaccagtacggcgtcgtccttcatcttggcgatcgtttcgtcattgatcatgtggatcgtgctttccagggccggtacgtggagggaaataacgtcagcttgggcgtagatttcgtccaaggaaacgtagtagcccttcttttccagttccggatccttaaagacgtcgtaggcgatcaccttagcgccgaagccttccatgatttgcatgaagacttgaccgatgtgacccgtaccaacaaccccaaccacttggtcacgaacttcgcggccgatggttggtgcccaacggaggtccccgttttcgatcttttcgtctaacttcttggattgacgaaggatgcgggccgtttggatagcggcgtgttcagcgatggcgttcggagagtaaaccggaacgttggtgatttcaaagcccagttccttagccttggccatgtcgatgttgtcgatccccacgttacgcaaggacatcttagtaacgccctggtcggcgagggcttggagcgtttcagcggtgtagtcgagttgttggtaaacaactaccccatcagtaccagctgcttgagcggccgtttccggcgtcaacagttcggccgtgtagtcgaccgtcacgtcagcgtggttctttgcccattcgttcaagtaaggttcttcgtccttgcggattccgtatgcgtaaatttttgccatgaatatacctcctgtaacatgtacgtcagcttggcaacgttgccaattactattatagcgaatcttgtcattatttaaagtaaaactgcatacaatttacccaacaaatcgattaaactaattagtgtttttttaattattttattgacgaacgacgaaaacgcccttatactaacgtcaataattagatagagattaaaaagctgtgacggaactactgtcggaacttcgtgaaaaagagaactagcggctggtggaagctaggtacgaaacccgaataagtgatcattcccgagctactagctgaacaaagtaagctaagttggttaccacccattatcctggtcgcgaatgaaagttcgtgctaagtggctcacttttgagcaagtaggatggtaccacgtgaaagcgctcctactccctaatgacggggaggaggggcgtttttgatctcgtcaattccaatacatagtgcgctaccagagttaaaggaggaagaattatgactgaactaaaccaacgccaagcagaatttgcccaggctctctaccaaagttacgtgaccaacgttgccctcaacgaagacgattggcagggcgtggtccaagactttgagaccgcctacgccgtccaggaacgggtgatgacactcaagggtcaaccgaccgccggctataaagtttctctgaccagcgaagagacccagaagatgtttgacaccgatgcccccctctttggtcaacaggtcgccgagcgtttcttaaaaggcccggctggggtcaacctcgaccacctcaatgaaccactggtcgaagtcgaactcgccttccgggccaaggaaaccctccagccgactgattcactagaggaccttttgcataagaccaccgtagcgggtgccgttgaagtgcccgacgcccgcttcgttgactggttcccgagcctgggtaagtacaacgtcttgtcagactgcgccgtggggggattagtggtttatggcgaggagcgtgacagcgaccaggccttttcctcggttgaagacgccgccaccgttcacgtcgacctctaccaaaacgggcaacaggtcggcgaaggggactccagcgaagtgttggggaacccgctcaagtccttgcagtggttggttaagaagcttgatgaacaaggcaagcagttcgcccgcgggcaggtagtatcttccgggaccttcctcttgccgccacacttgacggccgggcgctgggaggcccgcttcaaccacgacttcggcaacgttttggtcttggcacagccgacgctggcggaattttagaaagtgagtgcgacccaacctcctcgacgggccgttggactaagctaggatgggggttggtgcggaacgcaccgttctccggccgtacttaggcactaggccgacagtgtaaccataagagagaccgttcttaaggggcggtctttttttgagcaaatttctggcagaaccccttgacttggagttaactcaaagtagtaaattaaggtcatcaggaggaaaatgacatggcgaatttaataaatattggccggaatcccgtgactttagtcatgggatggataggcttctacttacgtcctttagggcgtttttttatttcattgtacttttgattattgatatattgctcaacgacctccttgctcatattccctaaagtactcatgtaatagctaggggaccagaggtggccaccccaatactgcgactggcggatttccgggtgtcgcttgaggaaaatgaaggcactgcgtcctttgagggctttgatagcgctagttggtgctttactaggtggaaaactaatcaacacatggacgtggtcaggcattacttccatgtgctcaatcacgatttcgttatctgccgcaaccgttgtaaggatttccttcatttcattcactaacgcttcactagtaaaagttggattacgatacttggttacccaaatcaaatggtagtgaaagttataaatataacgccgtgtataaatggcatcttcgattttgtccttcgacatgattgccacgctccttaattattattgtcattgacatatggtataataacactatatcagtgaaggaggtgaaaataaatgaagtcaatggcgaagatgaaatatcattacggactcaaggtgcggatttatccaagcgacaggcaaaagaaaattatcaagatcaatagtgatgctagtcgattcatctataacgaaatggtcgctattaacaaggaactttggcggctaaaacaggttaaactcccgattgataccattcagaaccggattgagcaactggagcttcgccaaagcgctaaacaaatgtctaatcatttccagttcttagaagataaaaggatcgatagcttgactaaagccaatgccattcaaaactaccataaagcttggaatgcttttcgcaaagttcataccgcaggtgtgcctaagtttcaccggaaaagttacgtctggcgttatcaaactaactgccagtatttgaaacagaaggcagcatacttaactaacggaactgtacattttgaagatagtaagcatgtgatagtgcctaaattaggtcggctccgtgttaaaggttcccatcaacgagtcttagctcgcagtgctgaaacccgtattggaacggtaaccatcgtaaaggacgctagcggtcgtttctttctctcaatgcagttagcgttggatactccctttgtcaattggccgcaaaatacaggcaagcagattgggattgatcttaatactgaaaacttcttaactactggtaatggcgatactgtggctaatccacgctattaccgcataattaagggtcgcttagccaaagcacagcgcatcttatcgcgacgggctcgtcgggccaaacaagaacatcgaccattacggactagtaagaactaccaaaagcaacgcttgttggtggctaaattacacgcccaagtctttgaacgtcgacgtgactttctccacaatgtctcgactacactaatcaagaaccacgatttcgtagccgcagaggaattgcggagtaaaaatatgctgaagaatcatgctttagcgatgagtattgcggacgtaggttggcggactttcttaggaatgttggcttataaagcagaactctaccatcgccaattccttacggtgaatcctaagaacactacgcaggcttgccatgaatgtggttttgtaatgggcacagcagggaccgaaaaactcacacttgcagaccgagaatggacatgcccaaagtgccatgctcaccacgttcgtgaccataacgctgcgcagaatattctaactaaaggaattattaaattagcctaatttggctcgtccctatggcaacctggggacgctaaaggcattggtaattgccgtgtaagacgaaacggttcgtagaactgttcgcagtggtgtatctatgcaaattgtgattcaaacactcatcagaagggtgcttgctcacaagccactgactttagtcagtggtggttgacttatgaaaacaaccgtctttttattccaccccaacttcgccaactcccgcgtcaacaaggccttagccgccggtttaccgggcgacatcgaggtccgcgacatgtacgctttgtacccggactttcaaattgacgtcgccaaggaacaagccgtgatggaggaaagcgaccggatcgtcttgcaaacgccgatgtactggtactccgggacgccgctgttaaagaagtgggaagacgacgtgctgacttacggcggggcctacgggagcgacggtaacgccctgcacggcaaggaactactggtggcgatcacgccgggggccgacaactacggcgccggcaagttcgtcccgtacacggtttacgaattgttacggccgttccaagcgatgggcaacctgatcgggactaagtttgttaccccgtttgtgacgaccggcgctagctcgatcagcgacgaggacttggccaagcgggtaaaagagtacgccgactacctgagccaagacgagttaaaggtgctcggcgcctttgaatagggggattgaaatgtatttaattgacattcgtttgaagggtgatcaggtcacggaagaccaactgatcgcccaccgccagtggtttagccgccactttgaagcgggcgactttttgatcgtcggtccgtccaagagtcgtgcccagtccgggttgattttggcccggcagatggcccgcaaagacctggaccaaatcattaccgaggatgccttttacccggccggggcggattacttagtcaacgaatttgaagccaagctggtagccgaccagattaagggggatgcgtaatggcactaacagtcagcctttattacacggggaaaaacggcagcgcccagcaatttgctaaggaaatgatcgaccagggggtggtggccgccattaaggccgagccgggcaaccttaagtacgattatttcattccctacgacgacccggagaccctgctgttgatcgatagctgggccgaccaagcctccctggatgcccaccatgcttcgccaatgatgaagcagttggccgagttgcgggagaagtacgatttgcacatgcgtgttgaacgttacgtcagcgatgaccgcggcgatgacgtcgacgaacagtttattcgaaagtaagagagtggcaaccaacctggtcccaaattaaaatgtggccgctccgcaagattgatcttgcgaagcggccgcattttatgtaggcaaaagttggattgcactttcgataacgtggaaaatgaccacagacctagtgcctaagtacgggcgaagaacggtaccaaggcatcaaccttcgccctatccttagcccacggcctactcgataggttgggtcgcacttccgataacgtgctccccagccgcaggcctagtggctaagtctgaccatagaacaccgctgatgcgctaacccgtgttctatccttagcccacggcctgcttgattggctgggtcgcacttccctttagaagtggaagcaagtaatgaaagtagcgaaggagaagaagacccctgggaagttagcccagaaaacgggccagtcgcggtccttcttgaagtaggcgtagattgaccacaaagaacagttgaccccggccacgaacggttgcagtggggcaccatattggccgtgtaggttattgatgatttgagcgatgtaagaaacgtacatcaggatggcgatgacactggcgaagcggccaagccaggagatgaacttttcagagtcaaatgagtgttcctttggttgttgcataatgaagatcctttccataagtaaatcctggattcaagtgcttccgccagcatgattgtagattaatgaaaaattgcagtatgtgaaagtcaaaagtaggatggcgattgtgcttagaaccaccgcccagtttggtggggtgaactttatgaccttcggcaaccaagcgcagggaatcgcttgcatcgtgaagtagttaccttcttgttaacggttacataataacgccggttataataactgtcaaccggttacatatagaaaaaattaaaatttattactcataaaatacaaatttaacatatataagccaatttaataggggcgtcaccgttgttatttaatataaaccggtttacacaaatttttagataattgggacggacgaaaaaaattaggtcggattttctagtttagcccacggtccgtcgaggaggttggtacgcacttccaataacgtgctccccaaccacgtgcctagtgcctaagtacgagcggagaacgacgccagggcgtcaacccccgctctagcttggttatacggcccgtcgaggagggtgggtcgcacttccaataacgtgctccccaaccgcaggcctagtggctaagtctggccgaagaacggtacgtgccgcaccaaccgttcgccctatccttagcccacggcttgccaatggttggtacgcacttccaaaacaaaaaagaccaggagcaagctcctagtcttccatcagctggtaaataatattccggtcgttcttcgagaggggacgcccccggtaggttaaattgacgttttcatcggccaggtcgaccgtcaccggttgccgaattgaccgttcatggtctaaaaggtaatcagttgatacctcaaacaattctgctagtttcgtgacatatgtactggaaggttctgtccggttcgtttcccacgctgtgaccgtggtttgcgaaatgccaatgtatttaccaagcatcgtctgggacaggttccgcccctttcgaaggtgtttgattctagcaccgatcattactataccccaataataagaatgattatcttccatgataacccatagaaaacctaaaagcgctaattattgaaaagtttaatagactttctggactctattaagctaatttaataaaaatgagcaaaaagaccacccagtagactaaatacaacatctgctgggtggttgaattaggaaggttgattagaggatttgtttggagtaggcgtcgacggcccggaaggcttgggcaacgtcacccggttcaacttcaaacggcaggcggtgaagggtatcggtcggggcacaggcgaccttaccggcttctaagagggcttcgtcggaaacgtcggctaagtggaggtcggccaaggtggtcggcagcccgagcgacttgatcaggcgcaagtacttgttgtagcgctcttcatcggcgccttctagcatcagctgggtcagggtaccataggcgaccttttccccgtgggtcagggcgtgggtctcttcaaagatgcacaggccgttgtggatggcgtgggccccggacaggccaccgctttcgaaaccgagcccactcatcagggtgttggcttcgatgatcttttccagggcgttggaaaccacgttttgttcgacggcggccacggcttggtgagcgtacttgaagagggtttcctcacacttttcggcgattgcgatcccgaccagggtttgcttggcatctagcatcgtgtcggcgccggattgggtgacggcttgggcctccacgttggtggccagggcgtccgcgatcccggcgaccaagaggcgggccggggcgttggcgatcacttggctgtccaccagcaccagttccgggttatggtcgtagaagcggtagttttcgaccgtgccatcttccttatagatgaccgacagacgcgagcacggggcgtcggtggaagccagcgttggcatgatcacgaccggcagcttagcggtatcggcgaccgccttggccgtatcgctggtcttcccgccaccgagaccgtagatggccgtggcgccttggtccttggcgatcgcggcgatccggtcgatttccttggtcgaagattcaccattaaagttgaccaaaatgacgtcgaagccctgctttgttaagtaagcttcaaagtccttgccgacggcttcgtagacgtggccgccggtaattaagaggggcttggtgccgaagctttccaggtagggcttggattcaaagagcacacccttaccttgaacgtaagaagatggggaagcaaaagctttaatcatgtcaattcctccaattagatattgtgtatgttttaacaatatcgataagggcgggggatgtcaagtacccttatcggttttttagtagggggagaataataataaacgcttttcttacaccccggcgtaattctaaaacttcctccaactttccctgttcctaggcaatagtgctttcgtttgccatgactgttccgtgtaacattcgggtgggcggatcaaataagggtaaatgggaaatggatacctatcgtgacaatgaaaaattttgagaatgctagtagcaataagtccaaccgtggtttctcgctgaacgattttgaagaactcccaaaagaagttgagcaggcgatgaaaccggtaaaagcggaggagttgggtctagtaaaggaccagagtgagctaggggctggccttgaagcgttacgtcagcggtgatcgtgaggaaagcatacaggacaaatctaaaattgggcgcaaagattagtgtttggcagattgcaagaaataacttgaacgaatttaatgacgtaaattaagcaggaagatctcgattggtgtgcgccagttaagacatttaagtggccgggaattcagataccaattgatttgaaccagctggcgatcgctcagctcttcaatggcttgtcccttgggaataaatcgtcgcaaaactcggttacggttctcattactaccgcgttcatgtggtgaataagcatgggcaaaatagacctgagtaccagtttgccgttcaattgtctgatagttagcggactctttaccatgatccacggtaagcgtcttgatcttgttttgaagttgactagctagttcaagtacggcttgagtcatggattgactgtcgcgaccatggagccgtttaacaattgtcaggcgactcttacgctccacaaaagtagccacagcttgacctttacgtttgccagaaagtacggtatcagcttcaaagtggccgaattcctggcgagtttcgactttatgaggacgctcctcaattgagcggccgtgactgaacgtaccacgcttttctttagcacgatgacgacgaattccatgatcaggcaaatcgggtaactgtacatcaagccagccttgatcaatccagttatagaccgtcttgtaggcaatcccaaaccacatgggcaacttgttcaggggaccacttctggacttgaatcttttccttgatcaagtgtttaaggctgatcaagtgtttaaggcttttagtaagcgaagactttcgcccccgttgactaatctttcgttcaaagtcagtttgcgctagctcagcctggtactcaccatttagtcggtgaagttcgttaaagatggtggtcttactaaagtctaagtagttagcgatgtatcgcaaggaacgtccttcattatgaagcgttttaatgacaacacggttctggaatgataaaatagtggtgctcatcaaggtccttctttctaatggattgtgtggtaacaccattaaagaccttgatgggtttttctgtccacttaaatgttcaacttaaattttacaatctgccataacaaaaataatctaccggttgattgacaacgcccgtatatttgtccaaaatataaatagaacttattaatttggagagattgatatgaccacagaacaatcgattgccgttgattactttattgagttaatggaaaagcaccgcgttcgggcgtgtgtgattcaaaagggggagcacatttatggggtcgttaaagccaagcacgaagccctggaagtacccttcaacgccgaccgcttaagctgggtaagcgaacgaaacgccaccgacgtcggaaaggcgattcgcgtggacgttttgacctgcctaaaggaactcctggtcgccaaggccaaccgggatcacaagtacttctctcgcctcgcccaacagctacaagatgaccttgaccaattctttggcttctccaagttgggcgatgaagaggtgctgtggaagggaaattactaaaattaatttttataactaatgtgaaacggcgggctttagattatcaaatgatgagaatcgcggctgggaagttcctcgtctgggagtgcgatcgtgacgccaaagaagttgttttagttgataaaaccgaattgttgactactccttatcagcgttaagtgaatgagaaatcaattagggtgatgacgaaattaataggagttatagttaacaattatagttattgatcagaaaatataatcatgactttttattattgggagagaagttatgacaaacgaacaaaaaattgctatcgaatacttcattgcattagttcaaaagtacgaactggcaggcagcgttgttcagcgtggccgccacccgtacgggatcatcaagtccgaaaatgatcaggtagaaatgcagtttaatgccgaacggcttcgttgggttgtcaattcttcgattgaagattcggttcagtccattaaggtggatgtcgtcaacaacttgcggtcggcgttgttggccgcgcaatccgttgaccagctgtacttcgaccgcttggcccagcgcctgcaaggggaactggaccgcttcttcagtttcatggaccttggtaaagaagaggttttgtgggacggaaccaattcataataaaaagggcgttgcttccggttaacggagcagcgccctgattgtaatgtttaaaaatggcacaaaaaaaacgccttagctctgaccagctagcggttattttttaagggtcaatcaattcatttcctagccccgcatagcctcgcggtccgtcatccggaccagggttagcaagactagtagggcgaccgcacagtagaccagggagttccagccgagggcggggaggccggccaccttgagggtttgggtggcggtaaaggagcttaccgcgaccccaacgttgtagaagatggcgtttaacgtggacgccagcgtggtggcctgggggtaatcgtggctggcgacgtctaagacaaagatctgaatcggggagccaaacagggcaaagaaaaagacgagtgcgcacagcagcaacagcccagtccaggcgttttgcatgctgaattggaagagcgctaatagcaccaggtcaagaacgtagaaggggcgcagccgttttatcccatttttggcggcgaggcgtcccgataatcggttggcaaaaacgtccaacacccctagtaacaagaggaccagcgacagggcagtgagcgaaaagccgagggtttggtgtatcaacgagcggatgtaggtgtagtaaccaaagatcatcccggccgagcaaatggcaaagacgatcgctagttggatccggcggtcggagaagagtaccaactgctctttaaaggaagctggttcgttgaccaggtctttggggatcaagttggtggccactacggtcgccaacaccgttataatggcgaccataatgaaggcgtcttgccagcgccagaggttggcgatgaaggtccccaggggattgccgaccaccgaagcgatgctaaagccggtgtagatccaggcgaccagcatggaccgttgctgatcggtggtggcgagttggtaggcgatcaccgacatcaaggactccatcaagcccgctaccgaggcggtcatcacccgcgaaaataagaagatcggtaggctgggggcaaaggcgctcaagagggtgccggctaaaaagaccgccagcaggatcaagaacaaggagcgtttattgaagtggttggtcgacagcgccaggagcggggtcgcaatcgcgtaggtccaggcaaagaccgagacgatcgaagcgctttggctcagggtctggtggtaggtgtgggcaatcaaagaaaggttgccgacgaccatgaattcgttacacccccaacataaaggagatcaagacaaacatcgccgctaagacgtacaaacgggtgtggttagttttggtgaccatagtatcctcaattccatttcgatttgccgacaggcgtttctttcattgtaaccgctaccgaaaaggttgggaagatgaaaaaagaccccagcagttcacgtgtgaactgctggagccggttgatgcaagttggaagaaaggacgccctcttgattgagttgaccctcgttgttatttttgacgattttgacatttgcctgctgatgctgatcgttgcgctaatcaaacttagcgtaaaaaaataaccgccttagcttgcaccggctagcggttattaaataactaaaagttggccaccgaaatatcggctctacccagggaggcttccgacagcctcccttttatattgttattatagcatgacgaccatgatggtcaaataaaagaacagttacaaaagggcgccaccagttcgcataagaacatggttggagccctttgtttaatcttcaatgtagtttaagcccacgacctgctttatggttggtccgcactcactacttgcccgagtccccgtagttggagaggacgcgagcggacgggtcgtcaacgtcgcaaccttcccagtcgctgtttggcatccagtagtccttgatccattcggccttgcccgggaagaattcttcaaagatgtcgcggtagagcaaggattccttggtaaacggcgtcttgtaggcgtacttttcgctggccttggccacgtcttcatccgtgtacttggcgtcggcgtattcctttaagtcgtcgaccatggagtggccaacggcgtcggagaaggccgctttttcccgcatcaagatgtcgtctggcaagtagtcttgcccggcaaaggccatccgcaacaggtacttccccttgtcgtagtggttcatcttcatgtccgggtctaaggacatcacgtattccacgaagtcgaggtcggcaaacggcacccggccttcaagcgagttagccgagatgcagcggtcggcccgcagcacgtcgtacatgtagagttcgcggacccgcttcatcgattcgctttggaaggcttcggcgttcggggcgtagtcggtgtacttgtagccgaacatttcgtcggagcattccccggtcaggattaccttcaggtcggtcgtttcgtggatcttcttgcacaagaggtacatcccgatcgaggcccggatggtcgtaatgtcccaggtttccagggtataaatgacctcacgtagcgcccctaaaacatcgtcgcgagtcatgatgaattcggtgtggtcagtgcctaagtagtcggcaacttcacgggcgtacttgagatcgatcgggttgcggtccatcccgatcgcaaaggtccgtaacctcttgcccggcattaacttagatgcgatcgagcaaacgagggaagaatccagccccccggacaacaggtagccgaccggagcgtcagcgtggagccgtttttccacccccttgaccaggtaatcacggatgccggtcgtggcttctgcaaaacttggcgtgtgcatccgggtaaccatggccgggtcgcggtaggtaacgaacttttcgccgtcgtagtagtggcccggtgggaacgggaagatttggtcgcacaagtccatcagggtcttggccgtggaaccaaaggcgatttcgcccctctccttggtgtagccgtaaaacattggccggatcccgatcgggtcacgcccggccacgaccttcttggccaccttgtcgtataagacgaaggcgaactcggcgtcgagcatcttgcacatggtgtccaacccgtacttacggtagagcgggatcaaaacttcgcagtcactagagctttggaagctgaagccgtcttttaagttctccttgagctgtaagaagttgtagatttccccgttacagaccagggtgcaatcttcgcccttgaagggttgcatcccgtcatcggacaggtccatgatcgacaggcggttaaaaccaaacatcaccgcgtcttcttcgacggtttcggtcatgtccgggccgcggtcaacgtttttctccagggcgtcgcaaaaggtcgttaaatcaaattccttagaatcaacagctaaaaatccgcacattgtaaagtctcctttgtggttaaaccgtggatgaaaaaaataagcctttcaccccttgcttttgacaagggacgaaaggcttatttccgcggtaccacccaagttggctagggtattactagcccacttttcattgagtacaaacatactcatccggtggtaacgttccggtcacgactaagcctactttgtaatgcatttgggttagtaatcttcgaaagtgttattcaatcgcagagggttggtcaggtttccactagccctgactcactggacaaatcaacgacctactcgtctttctcatttttctcttatttaatttttccaattctagcgaactttatttaagttggcaagcccctgaagcgatttttttgaaaaaagtgtaacgccccgaccaaaaaaggggccaaaatggggtgaagaacgaacttcttaaattggggtgcagatccggttcggaagtgcaaaagctcacccaaagaagcttattaaccctttctaataaatcggctaataattgattctataataaagtatgggtaaagaaagcaagtagggaaggttaattcacccattgggggcgagaagtggacgaaaaacgcaccaatgtaattgaattatggtgattatttatacgctcaagcatcagtagacaatatataggtcgcaagtctgatataattttaggaaataaattaattcccgggtgagcaactcttggggtctggcgctgacgttcgcgtggcaatccgatcaataagattttaaccacttggctaaggaccgcagtgaggtcgtcaaggcggcgatcaaaaagtacctcagggaggtggccgaagatttcaaagcccacatgccaagcaaggaattgatcgtcgacaaccagcggctgacccgccacgaactgtccaagcagctgggcgtggaaatcgatttgatccgcaaccggacgccccgggatggccaagtcgaagtcgccaaagaacggctcgtcaaggagaagtgcccggttaaccaccgcgtcgaaattaacggcgaacggctgagcctgccggagttagctgagtgctaccacttgtcggttgaaacggtctacagccgctggaaacgaggaaagcggggcgttgaattgattaaaccagtacaaaaatagcgagattgggagtttaaaatgattgagattcacggaattgataccgatgaggcggggcggtgcacccattaccaccaggaagttgacgtggccgccctcaagtgcgcccggtgtcaaaaatactacgcctgttaccagtgccacgattaattggaagatcacccctttgccgcctgcggcaaggaagaactcgccgtggtgtgcggggaatgcgggcagggcagcagatgaactttgcccagtatgctactggcacttgtttaaactgccagcaccccttcaatcccggttgtaagctgcattatgacatttacttcaagtaaggaaaacgttaccgaaccccacggtaatgtttttattttgcccttaatttataacgaagcgcccctcaaaaagacagtagggcgcctttgtgtgctgaaaaaccgaacgatcgtcaggagtgattatgatggaatgatggggcggaaatggaggttaatggacgaatgcaccaagttggctccctggcgttgaaatgcgctaagttgatcctaaccagtgctaaagctgggctaatggtgattagtgagttctttttctgaattacgttaaagcgggacccgatcctaacgtttaatttataaattgaggcaaaaaggatattaaaatcccgaacaataatgtttattaggtgattaattgatgagttgacctaattaatctattgatatatgatgtgataaatcaaattgatcaaaaaccacgggtggcatcgaacgccgactttctcaattacggggaaaaggtgttttttaaaccagttcgttttatcgatggataatttatgcgggcgctcgtggcggatagacatctcaaggagaagattacgattatggttgggaaaaacaatcaaaacttacttgagcagaagatgggccaacgctacacccgttggtcgattcggcgccttagcatcggggtcgtttccgtgttgcggtcgcctcgggggtcttcttgttctcgagcgtggccttagggccaactgcccacgccactactaaccccgaagaagtcgggcgctcagctcgtcaaccagcgccaccagtggggaagccaatgccacgattgcggtggcttccgggcaaagccaagccgccgctgcttccagcgccgccgcgacgagtgacagcgccgttgctagccaggccagcgccaccagtgatgcagccagccaagctagcgcagcctcaaccgaagccagtgccgcaagtaacgccagctccattagtgacgcagctagcgccgccagtgccagttccgctagcgctatgcctgctcgccgggccgtccgtcggatgttagcaactgcgacgagtgagtacgaaaacgtgccgtcgactggggagacgacgattaccaaaagcgacccggggaacatgccggctggggtgtataagaatgtaccagccgatcaatacgtgtttgaagcgttgattgttaatggtggtgagtatgaagacgttggtcacacgattacctttgcaactgatcgggcggggaaggggattctctatgtatatgaagaggatgccaaccaccatttggtaaacagttacacgctaggctaggaccagtcagagttatcgcagagtttatacggggacttaacatactacaatggtgacgggacgatggttgttgattcgtacatgtcgaattcaatgtacgccaagccttcgatgaactacctgtggttctttgggcggccaactagttcccaataccttaacacctcaaagtactacaatttgacggatattgttccgaagttgttgacgcagaaggtatactacgttgacatcgacactggtcaacaattagcggctccgtttgaaacgcagtcactgacggggtaaacgtataagatttctaacaccaaagagtttgagcacttcaagttagttaagtcaccggcagaaataaatggttcagtttctcaatttgttaacgatggtacgactgtgtacccatataagggctacaattggcggggcatttcgtggcaatacatctttgaaaagttaaccacctacctataccaagaccttgtaaacggcaccggggaagatccgctcttaaagaaaaaggtggacgcgaacgaacttggcttaaagaccgggcgtggctttttcgacttagaaggggacgccggtaagcagatcgtggctgaccgggataaggcccttttggaactgttgaaaaaagaccaggagcagtaatcagggttgcggcacccattgagcatactgaaatacaacaaggggctggaagaaaacggtgttcttccagccccttgtttcttatattcgctgtaactctttatctaaccggtaatccttttggggaccgtttacccaggtgtgttgggcgaagtgagcattgtccagttcaaaacgggcgtcgtaagtgtcgagggcacacaggtaggtgttgtccgggacgaggaggtgaccgttctcgtccaagcggtaggcctggtaaagttcatagttaccagacggttggtcgtgaaagtagaccagcacccggtcacccgcaaattggtagcggtattcccgccaaaaggagaggggcgccgccgttttacccatgatcatttcgccgttctccgtcaacaggaggctatcgggagagagcggagaaaaacgccaggtgccgtgcatggtggtggcgtgccccgttaagatgcgggacgtcccggtcaattgccagtcacccaaaaaataatcgtagagcttcaaaccgcgcctcctagcccgtggtgccttccaaaagggttaccggcagggtcacggattcgacgttggtttggccggcaatctgttgttctaacaggttaacggcgaccgccgccatttggtcgatcgactgttggacggtcgtcagttccgggaacaggatccgggtgccgtccgcgccgtcgaagccgaccaccttgaggtcctcggggacccggcggccacgggccttggccacttggatgatcagcccggcgttggtgtcgttgtcggcaaagatgccgtcgacttcggggtgttcgtcaaagaggcgggcgaaaatggcctttttttcctccatcggggtgtcgtaattaacctcgtaggtaatggcggggtaaccggcctggctcatcagatcctcgtaggccttgcggcggtcctggttggtggtcatgacgtccttagggtaattggtgtggataatgtgttggcaaccggcgtctagcagccgctgggtcgccagctggccaccgcggtagttatccgaggcgacgaccggaatttgcggggcgaccgcgcgttcaatcgaaacgatcggtaagttggtctgcaagtaatccggcatcgcctggttgtgggcgccgacgatcaggccgtcaatctggtggtttaagagcaattgtaagtactgctcttctttttgcgggttgttttggctgttacccatcagggtccggtagccgttctcgtacaggcactcgtccaactcggcttcaagctggccaaagaaggggtcgttgacggtcgggaagaccaggccgaccaggttggtcttttgggtaaagagctggcgggcgattgcgttggggcggtaatggagctgttccattgcctcgtggacccgttgcttggtggcttcgctcaggtagccacggttgttgaggacccgggaaaccgttgttttggagaccccggccagggccgccacgtcttctaacttaacttgtctgcgtttttccaagatagcacctcgactgcactgctaaaatgtctggccactgtaggggtggttgggcaaattggtgaagtcaagcgtggcgaggtcggcaacggaagtggtgtagtgggtcagcgcttggccaagcattaagttcaaaggctcgtccagctcttgcacaatcacgatcggcttgttagagtgataagcgtagccaacttcaaaggcggttccggaatcgacgttggcgtggacaaaatcggccacggccaccactaggtcggcgtcgtcaatttcttcgacgtcctttttgaaaatcatctgcgcccattccggcgtaccttccttgagtaagggtgtgctattttcatccgacaggcggggggagaagaaactgtcgaccgtttggttttgggtgagggcttgttcggcccgggcgatgcggtcaatttgttcatcgctaaaaaaggccctgctaagtaaatgcgcataagctgttctcctttaatgattaatataatttaatggttaatataattattgtagcgaattgagcaaggcgacacaattgagattaagacaaaatatttgaaaggttgaattcaatcatgatacttttagtggttttcggtgggttaatttttgtgttggggtgcttttacctggttaattcctggcaacagtaccaccagtggaagtttgccaccctcttggtgctagtgagcttagcggtaacggtgtacggagttatcaacctgccttattggcataaaaacagcagcgcccagactagcagtcagaccagtgccaagagttcgtcgtcgggcaccagtagcaacagcatcagcggctattctaacaaccccgctttgtcctcttcgacggccaacatgacccaggaacaaaaagaagccgccgttttaaagcagctccaatcttcctattctaagttcggcagcgtggcctttgattcgggctccaagacctttcaaatcgacccgtccagcggcgacgaggccgactcgctcaagtacctggcccaaaacccaacccaagccagcagcatgggctggtcttctctgaccgattcgctggataagacgtcgacgcaagtgtccaagctcttgggcagcgactactcgatcagcttgatgaaccccaacgacaccagccaagcaatgtacacaaccaagaacgggagcaaaacttacgacattgctgaccaataatcgcttgcacgtctatgtaagtaatgctatacttacatagttgttacggagagttggcagagtggtaatgcaccggactcgaaatccggcgaacccatgttgaatgggcgcgcaggttcaaatcctgtactctcctttcatgtttaatttaactccgtcaagttatctgaacatggtgagcctagaatgttgttaaatcaacgttctaggctctttttgttactatttgcttttgttgggttacggataatttcggttaattttgacaatggttgggtcccgttgattgattcacctggacacctcggggatccaaaaggacccaaaattagacaatttgagtagttagttaattttcttccccacgtacaatagcctcaaaagtcatcactttttatttcttaaagtgacaacttttaaggctattgtacggctggtactatcccctgtcaagttgacacttataaaaacgaaaacacaatttttcttatccaaccaaatcgtggtaatattccgccacggtttggtcatttcttttagcggaaatgaactgattcgtgaagtacattattccagcacgaacctgttcctgtaactctgctagagtttgcgcctttggacgatgctcgagccagatgcttttaaaatctgcccaccagtgttccattacggcgttatccgctggtgtcccaggcgccgataggctatgccttaccttctcctgacggagagcttcgttgtaattggtggacgtatatgccgctccacgatccgtatggatcatttctggagtggttccactagccttagcggcttggttaaagactttgattgcggcttctctggtctccgttggtgagattaaccatgctactggcctttgtccatatagatctaagatggcgtgtagacggactttattagcggtcccgtaagtcagttctgttgtatctgttacccaaacctgattcgccttttcttgcttaaattgccgatttagtaggttctcatcttgataggtttgttttgctccctggcggtccttttttggctgccggtaatccgcccgaattccattaattttcataatcctgctaacccgcttaatccccactctgtaacttaatcggccctctttattcaatagacgaaccatcttatcgtatccaacactatcttgatgccgtttttcgattcgcttgatctcctccagtacttcccgttcctgctgttcgcgtagcgataatctacgatttaaccatttgtaatatgcttgccgactgattcccgcaacttgggccgtttcactaactgtgtactcgtcactgctggtcatttcttgaaccgcttgatatcgtttggccgcttcacctcccggttgcttatttcgatcaatttttttgagaaggcaatctgaacctctctttcacgtaatttagctttgaggtcccgaatctctttgagtaactgtttctcacggtcggctggttgcctacccctggtcttgccacgccggtcctttagggccgtccaatcgtttgcttgctcgtatttctgtgtccaggcatacgctctggaataggtaatatcaaacttttgcgctgcttgcttgtagtcatgattatgcttcaagacccatttaacgatttcgattttctcgtcatacgagacctttcgtcccatcttccgcacccgctttcttactggttctttaccattattgtaaaggatgtgggcctagaataaaaagtgtacaagttaaatagagactctgatttagtataattaaggaagtaaattggaggatcaaataatgacgaagcacagttatgacaaggaatttaaggaacaggccgttcagtattacttagataacaaggatcacatgaccatgaatgaaataagtaagaatctaggtattggggctagtacattacataaatggattaagctgtttactgagactggggagtttggccgtggctccggtaattttgccagcgataaggacaaggagattgcacgactaaagcgtcaacttcgtgacgctgaaggagcgatcgaagtattaaaaaaatcaatcgggattctgagcaagtaactaccgaaaaggtataccaagaaatggacgttcagcacgctttggaatcccacccttccatcaatggtatgtgtgattatgttggaatctcaagaagtggttactatcaacgagaaaagcgtcataatcaccaatcaccgcgaaagcttcggaagaagtttattcaaggtgaaattaaagcaatttggctcaaaagcctttgtatttacggtgccggcaaaatcacccaagaacttcgctcaaaaggatataagatcgctgaacgaactgttggtaagtatatgcgtgaacttggcattcacgccgtttacctaaccccttggacgactaccactcgcaattctaagtttgataaacagctaataaatattttagacgagcagttcaatccattgcgaccaaacgccgtttggtgcattgacaccacttatattccagttcatgacggattcgtttatttaaccagtattatggacttgtactcccgacggatcattggttgggacttatctgaaaccttggaggtatcgaatgtcatcccacttattgaaaaggctaagcacagtcgccatattagcaagccattaatcatgcacagtgatcgtggtagtcagtttacgtctgaagcttacaatcaagttacagctaacatgacattaagctattcaaagaaagcttatccttgggataatgcctgcattgagtcgtttcattccttgattaagcgtgaatggataaatcggtttaaaatccattcatactccgaagctaaacgactagtttttcagtacattgaaacgttttacaacacagttagaattcacagtcactgtggattcaagtcaccaaagcaacttgaagatgagtatcaaactcaaattcaaaatttagtcgtggcataggacaaaaaagtctctatttaaattgtctattttattgacaggggaccaatgacccagttacgaagttgggataatccacggatatcatactttaataggatttctttggtaggaagacggtgatttcgataatcacggacggcacgaagcttaagcttcttagggtaccggcgattgtgtactgggcgctctaaattagccaatccgccagttagatactgctggatccaacgctttaaactccctgcacctacattgtgataatcagcgaaaaccttgagtgactcgttaacgttttgaaattgacttaataagcgaagcttagtagtcgttgaataggtgattttcataaaaatagcctcaaaagtcatcactttttatttcttaaagtgacaacttttaaggctattgtacgaggggaccaaagtgatacaattccgtttaatgaaattttgaataacaatgtttcgatggaacacgaagctaaggtatcaaaaatttccgaagagcaactctattacctgatgagtcgaggcatttcggaagccaaggcgacggaaatgatcattatgagctttgtggaaccctttacgaaggaactaccgatggaatacgcggttgaattgaaccggctaattagttttgaaatggaaggctcgattggctaagcaccgattaaaatgatgatcaaaaacgcgttaagcaacctaaggaggacgtcaaatgagtacatcagctgactttaaagaacgcgcactggctacgtttgaaaacgtaattgacccagaactgggaattgatattgtgaacctcggtttaatctataacgtcgaattgggcgacgaaggcacatgtaaggtgaccatgaccctcacgattgcaaggtgcccgttgaccgaccacttaaacgacgccatcacggaagagctttctggttttgacgaggttaaaaacgtcgacatcaaccttgtttgggaaccggcatggtcgattgaaaagatgtcgcgagaagcacgaatggaattaggtattcattaagcagataccttgttagacgttaaatgatcctcactgcagagttaatctggggtgaggatcatctttttatgagtaatcagtggcggttgaccgcattactgataatgattttctcatttttagattaatgtcgtgatgtactaattactgatataccggtggcaaagaatggataaagatggtagtgaaaataaaattaaataaaaatgagaaattgtcttgcgttctctaattatgagcggtatattatgagtatcaaatttgaaggaggttacgaccatgaaacaggtagaaattaacagcaaacaaattattgcgaccgcggccgtaaccgcaaaacttcaagccctattattatgatgctggactctgacaattaatgtcgagtcctatttgcgttatgaaatggggcttgaccagcaccccatttcaatggggtgcttttttatttgctaaacagggattaaggataaggaaaggtgattcatatgactaaacaaattcaattttttgatacaacattgcgtgacggagaacaaaccattggggtgaacttcagcattgaagaaaaggaggttacgaccatgaaacaggtagaaattaacagcaaacaaattattgcgaccgcggccgtaaccgcaaaacttcaagccctattattatgatgctggactctgacaattaatgtcgagtcctatttgcgttatgaaatggggcttgaccagcaccccatttcaatggggtgcttttttatttgctaaacagggattaaggataaggaaaggtgattcatatgactaaacaaattcaattttttgatacaacattgcgtgacggagaacaaaccattggggtgaacttcagcattgaagaaaaggtagaaatcgctaagcagcttgaagcttggggcgttgattgtattgaagccggcttccccgtcgcctctgaaggagactttgaagcggtcagtgccgtcgccgcagccgtgaagcacacatgcgtcactgggctggctcgcgcacgcaaaggtgatatcgacgcatgtgttaaagcaactgcgcaagccgctcataaacagatccacgtctttatcgccacgagtcctgttcatcgtgaatcaaagctacatatgacaaaggaacaggtccttgaatccattaccgatttagttacctatgcccatcaattcttcgatattgttgaattttcacccgaagatgcgacgagaaccgaacatgattatctttgtaccgcaatccaaacggcgattgatgctggggcttccgtgatcaacattcctgatacggtgggctacaccaatcctgctgaattcgcagaactcttccaatacatgcaaaaacacattccatcatttgatgacgtcacgttctcagttcactgccacgatgacttggggatggccgttgcgaacagccttgcttccattgaaaatggcgctactcgaattgagggaacgatcaacggaattggcgaacgtgccggtaacgccgccttggaagaagttgccgctgccctctacgtccggaaagattattacaacgcggaagataatattgatttgaaggaaaccaagatgacgagtgacatgattagcaactatgcgaatatgcccgttccccggaacaaagccgtggtcggcgcgaacgccttcgcacatgaatctggcattcaccaagacgggatgttgaagaacccaaacacctacgaaattttgacacctgaaacggtgggggccaataagacaacgttaccactcggcaagctttccggttcccatgcagtgatggccaagcttcacgcaatgggcttcaaggttgaccgtgaagaaatgaataaaattttcccaatctttaaggataaagcggatcatacttcaattgtgtccgaagatgatcttcgtgaaattatgaaacaaatcaaaaaggtggtcgcatagtatgcaagaaaacaagacagctcaaattgccgttctcgccggtgattacattggtcccgaaatgatggcagccggactaaaggtcctgcaagccgtcagcaaagaggggcgctttgaatacaaaattcatgaagagccctttgggggggcggcaatcgatcaagcgggtgatccgttaccacaacaaacgcttgaaacgtgccaacaaagcgatggtcccctgtcaataaaatagacaatttaaatagagacttttttgtcttatgccacgactaaattttgaatttgagtttgatactcatctttaagttgctttggtgatttgaatccacagtgactgtgaattctaactgtgttgtaaaacgtttcaatgtactgaaaaactagtcgtttagcttcggagtatgaatggattttaaaccgatttatccattcacgcttaatcaaggcatgaaacgactcaatgcaggcattatcccaaggataagctttctttgaatagcttaatgtcatgttagctgtaacttgattgtaagcttcagacgtaaactgactatcacgatcactgtgcatgattaatggcttgctaatatggcgactgtgcttagtcttttcaataagtgggatgacattcgatacctccaaggtttcagataagtcccaaccaatgatccgtcgggagtacaagtccataatactggttaaataaacgaatccgtcatgaactggaatataagtggtgtcaatgcaccaaacggcgtttggtcgcaatggattgaactgctcgtctaaaatatttattagctgtttatcaaacttagaattgcgagtggtagtcgtccaaggggagtgtaaaatattttgtgtaaattgataccttgagggtattgaaaaagggaaagccttccccgtatgattgaaatcgctaaaaaccaatcagaatacggaggctttccccatgaaccagtttaacaaagatattatcgcagcgctatcttcagacaaagatattaccctgaatgaagtcttacgtcgtcaaatcgaagtggccgctaatcagttccttcaaaatgaactgactgcagtgctaggctacgaaccacatacccggatcgaccgatcaaaaggcgacgtgaactaccggaacggggcgtacacccgcacgattgacactgagtacggtgaaattaatctgacgatcccccgggaccggttaaacaagtttcaaaacgccctcttccctccttacgtgcgtcggactgatggactggaggaaatggtcatcaagatgtactccaagggcgtcacaactcgtgaaatcgctgatatggttgagagaatgtacggccactactactcaccaaccacggtttcaaacatcactaagcggacggaacacctggttgaagagttccacgagcgcaaattcaagtactcacagtacgtctgtgtgttcctcgatgctacttacattccgttacaccgtggtaccgttgaacgagaagccgttaacgtagcgatcggaattcgaagtgacggcggtaaggaagttcttgactacagtatcgcaccgaccgagaacggagccgcttggtctgaactactccagggattacgcgcacgggggattaaagatattcagttgttcatcgccgacggtttagttggacttcaatctgcgattgaggctaactacccgcaggcgaagttttaacggtgctgggtccacgcagagcgcaacctgttagggtacgttcgcaaaaacgatcgcagggagattatcaccgactttaaggctattcggcaagcagagaacctacaagtcgccaaagaacgattggcggctttcagtgctaagtgggagtccagttataagcgtcgaatcaagaatctagttcaaatggaggagctattcacgttcttcagttttccaactgcgatccgtcagaccatctactcgacgaacctaattgagtcgttcaataagagcctgaagaagatggtccgacgtaaggagcagttcccaaacgaaggggccctcgatcgctttatcatgacgcaagtgatggagtacaacgataaatttgagaatcgagcacatcggggattcaaggactgccacgacacgcttgattcgatgttttagaatcgccaattcatgcgggcgaagtttccttttttacacaacattcttgacactctctttttccgtcgttgaatatgttcctattcaaaacacccctagagatgacacttttattatttaaagtgtcaaccctaaggggtattgtacgcgtccttaaaagaacgtgtttccttgcccgctttcaaaaacctggtgggcccgtttcgccacgtcgtctgggatcgaaaagtcgatcagccgttcgtccatggtgagctcctttctggaagtaagcttccgttgggttaagattccaattgactgaaccaatccccgcgatcgttgtcggatgaaaagtcatcttcggtgagagggcagccactaaaccgggtggcaaagtggctggtggcggctggttcaaaggggagcccgcccatcttggcgacggtagtatagaagttctttaagaagaccgaccgggaaaccccggcgttattacaaaagtcgtctaggtaattgagtagtaaatcgtcgatgaatagcgattcaatgtgattagccatagtgattccccctatctatttgctaattatacctgaacaatagagatttagtatgaattataactatctatcgataaatttaaagatcgttaagttgaccgcttaaaaacgaaagaatcaaaagttggcgccgtgcttttagatgctttaagacaaagattagagaagccttttcttacggccaccaccgctgtatactgaatcaagattcggaggaagtataaatgacgggaaattaccggagtgtttttgatatcattggcccgatcatgattggaccttctagttcacatacggccggggcggttgcaattggtcgggtggcccgccaggtgctcggtcagacgccggttcgggtgacggtccactactatgaatcgtttgcccagacccaccagggccacggcaccgattacgccatcgtggccggcctcttgcaaatggatccggctgacccgcgggtgcccaattcgcgcgaactggcgagccaggccgggattgagatcaacttcgtcgaagaacccggcgcaagcccgattggtcaccccaacacggcggtgctcgacctggtcggcgccaccaagcaggccaggctgtccggctgctcggtcggcggcggaatcattgaggtccgtgaactggtcctggaaggggtggcgattcaaccgtctggccccctgccaattgtcctcttccaggccccggtcgccgatcaagccaagcaagagcaggggcacttgttaattaacgacctggagtggaaggccccctttatcaagcaacaggtctttaccagcccgcacagcacgatttgggcctttgacctcaaggactacctgcaagacgacttgcggacctatttactgcaaacctacccgggcatcatttgtttagaggagtcgtaaatgtttaaatcgattgatgaactggtcaccaccgctaccaaccagggtttgccgctgtcggaagtgatcatcaaccaagaaattttaactagcgggaagtcgcgcgaacagattttccaacggatgagaaacaacctcgctaccatgaaggcggccgttgagcgggggactagcggccagggcgtccactcggcgaccggtttgacgggtggtcaagccgtgaaggtcaaggagtaccgccagacgcaccgcaccctgtccggggacgccatgatggccgccgtggaaggggcaatcgccaccaacgaggttaacgccgccatgggggtgatttgcgccacccccaccgccggttcttccgggaccctgccggggatcttgtttgcccttaacgaccgcttgaagttgaccgaagaccaaatgctacactttttgttcaccgccggcgggatggggatgatcatcgccaacaaggccagcattgccggtgcttccggtggttgccaggctgaggtcgggtcggcgagtgcgatgggggcggcggccgccgtcgaaatcgccggtggcacccccgttcagtcagccaacgccctggcgattgccatgagcaacttgttagggttggtgtgcgacccgctagccggcctggtcgaggtgccctgcgtcaaccgcaacgccaccggggccggtaacgccctgatcgctgctgacttagccctagccgggtgcacttccctagtgccggccgacgaggtgatcgcggcaatggataaaattggccgccaaatgccagttgaactgcgtgagaccggtctaggcggcttagccggcaccccaaccgggcaacaaattaagctccggatctttggaaaggacctggagtcatgagggcgccggaagagatccaagcagacatcatggacgctttgacttcagtgatcgatcccgagctgggcgtcgatgtggtgaacctgggtctaatcaacattgtcgacctcaaggatgacgggatctgcgacctctcgatgaccttgacgatgatgggctgccccttgcagggaattttacgccgggaggtgacccaggcgttagtaacggtgccggaggttcaccacgtcaatattgacctggtgtgggagccggcctggacggtggcgcggatgagccgccaggcccggttgctcttggggatccactaaaattgaagctgctgttttttcaggagggtgttcgtcgtttgataaccgaacggcgagcgccctttttgcgtccaattaagcgaattttaatctaattttgtccccctcgtaagggtgaatattagcaagattatctatctatgtctatagatagattaagcgaaaaatatttatttaataatcaatatcgataaaatcggataataagtcaaatccttataaagaaatatttgtaattacactaaagatataaatatctattgattatatatcattgacgattaggctttatcgctgttaaagtaaaatcaaagaaagtcataaaaacgccacacattagaactggttgataaaatgatgaaactttgatgatgattagggaacctcgaatgtcgattaggattcgcgatattaagacgcaggagatggttcaggttacgcaaagatcgctttaagaagagaggggatttccatggttgggaaaaacaatcaatggctattgaagaagaagatggggcagcgctacacgcgttggtcactacgccgattgagtattggtgtcgtttccgtcgccatttcttccggggtctttttgttctcgaacatgatgctagacccggttgcccacgcggcgaccacggatacgccgaccacgacggccatcgccactcctgctagcgctagtgcaactaccacaccaacagcgacgaccacggactcgagtgcttccaccacctcccaagctagcaccacgtcaacgacggctagcgctagttcggtaacggctcagacgggctccgcaagttcttcctcagcaacgagtgcggcaccggtgtcggtcaagcaggccgtcttggcggcggcagcaccggcggcgagtgactcaagcgccacgaccagtgaagccgatggtgggctggctgacatgtccgacgccgttacttccgaatccgacatccaatacaaccaggcccacaaggggaagctggttaacgttgataagaataactttttagactacaaccagacgcacggttcggcgacctacgatagtgcaaccgggatgtgacgctgacacctgaccaaaataatctggccgggagtgtgaccttaaaggataagatcgacccgaaccacgacttctccttgacaacgtggaccaaccttggtgataaaaatacccaaaattggggtggtgatgggattggttttgccttccacactttcccgcttgacgccgttggtttcaagttggataccttccataacccgcgggcaaagatgagtgataagccaggcggtgattcttacccagctgaccctaaaaattctgggacgggctcttatggtgcaatggtatataccgattacaatacggagctctcttctgatggtacgaccaagcagtggaaccttgaggtaccagaaaacatcaatagcttcactaacggaacggaccccgcaactactcaaaacgcagaggttttaccggatacggtgacggacggcaagttcataattaactacaaggccgcaacgcaccaattggtagtcacttactacccggatagtgacatggacaccgataccttaggggatgcctacgtttggaactggacaattcctgacgaccagtaccaaaaaatggtggccgctgccgtagctgaacgggacagtgcggccaacaagggcaagtacacggccgactccctaccaatttcaatggccatctttgcctcaaccggatgggcaaagaacctgcaacaggttaagatcaccgactttgattacacctcctgggaaacgaccgggtcggcagtcctcaagtacgtggattccacgaccggtaagacgattgctcgggacagcgtgcagggtgacccgggggccgcaatcaacttcgggaccaacaacgttcgttacaccaacacgctcaactactttaagaaccacggttaccaattagtgcctacccaaaccttaaccaccgccgataaggacgctggttacgtcctgatgcaggggacgactgctagcgaccggatctttgacgataccgattcggtacaagagtacgtggtttacttagagcacacttactccacggcgactgaggacaagacgatcaccgaaacggttaagtaccaaaagaccaacggtgaagaaattgccccgagtgaaacgaagtctgtgacggtgacccacagcgggatcaaggataacgtgaccggccaggttaactggacggaagacgataagggtggcgccgatacttggaccttaaaggatggcgattcagccacgattccaagggtcacttcgccaacgattgatcattacgtggcggataagacgacgatcaacccggtaacggttgacgtggctaagatcaccaccgacgccaatggtcagatcacggtgccgctatccggcgacccgaacgcaagcacggtaaccttcaccaacgatggcggtaaccaaacccaagagctgacgcaggtcgttacctacaccgaactgggaaccttctccgtgcaatacgtcgaccaagataacggtaaccaagtaattccggacacgggttacacttcggctgtgaccaagtacggcgaccaaattacctactcaacggctgacacgattgcagacctggaaaagaagggctatgtccttgtcaacaacgagtttgaccaaactggccaagcctttggcgacagcagtaatggtcacacctacacggtgacccttaaacacggtcaggtaccagtgacgccggagaacccgggcgaccctggtcaaccaattaacccggacgacccagatgggccaaagtggccagccggcaccgccaagtctgacctgaccaaagacgccacccagacgatccactaccaggatgcgggcgacaagacgccagccgacaacgttactactaaggctgacgccttcaccaagacggtgacggtcgacaaggtaacgggtgaaattgtttcccaaacagacttcaccggcgacccatacaccttcgggacggtggacacgccggtggtcgacggttaccacactgaaaaaccaaccgccgggggcttaacggcgacggttgacaacccaaacccaacggacacggtaacctacatcgcaaacggccagctgatcccagtcgaccaagacgacaacccaattccgggcacgccaactacgacctacacgaccgatccaaaggacccaaccaaggttgtcacgggaattccggacgtgccaggttacacaccgacgatcaacggccaaccggtcacgccaggtagctacacgccaactgacccgagtggcgataccacggtggtttacgtcaagaacaccagcgtaatggttgaatacttcgaccaaacgactggcaaggtcttaaagactgacacgctgaccgggttgatgggtggcgacctcaactacacgaccacttcaaccatccaaggttacgtggccaagggttaccgcctcgtcagtgaccaattcaccgacgccggcacgaccttcactaagtctaacgacggcaagacctacgtggttaccttggcccacaccacccagacgcagtttacacggttaactacacgccaaacggccacatcattccggttgacgaacaaggcaacccgattccaggtgccccaacgccaacctacacgactgaccaaaccgacccaactaaggtaacgccaaacaaaaaggtacctgaaattccgggttacgtggccacggtaagcacggtgacgccaaccgacccgactcaaaacaccaaggtgacttacgtcaagaaagacgccgccctgacggtcctcttcttagacaagacgaccgggacgaccttagcgacggtcaacgtcgacggtaagtacggcgaccaaatcaagttctcaccggccgagttgatccaaagcttcgaacaaaagggttaccacttgatcgtaaacgaattcggtcaagccggtaccacccttggcgatgctaacaacggtaagacctacctgatcgaatttgagcaccagaccaagacgatcacgccaagcgaccctggctaaccggggcagccaatcaacccgaacgatccgaacgggccgaagtggccagccggaaccggggcgagcgacctggttaaaggcgctacccaaacgatccactaccaaggggtcagcggggttgaagacagcgtcacgacgattaagggcgcctttgaaaagacggtcaccgtcgacctggtaacgggcaagatcgtcagtgagaccgacttcaccggtcaggcaaactttgaaacggtcaagacgccagtggtcaacggctaccacgccgacaaggccctggccgggggcttaaccgccacaccggaccagccaaacgtcagcgacacggtgacctaccaagccaacggtaaggtagttccagtcgatgaaaatggtaagccgatcctgggtgcggaccaaccaacttacccaaccgacccgagcgacccaaccaaggtgctgccggttccagtaccagcggtgccgggttacacgaccaagacgactatcgtgacgccaagtgatccgggtgccaacacgaccgttacctacgaaaaggtggtcgacgaagcaccaattacgccagcaacgccagctaagccaaccgccacgccacaggctaagcaggcaccggccaaggaagcggctaaccaagccacccttccacagtgtaaaaaggaccccgctaagttcaggcgctgaacttggcggggcctttttgtgtggcgcgcaaaataattgaacgttttggcggcaactgggcgggggacacaggacaaatctacgaatttgcgcaattaaaaggagtgcgagccaacctcctagccatgagcctagtgcctaagtacgggcaaagaacggtgctgacgcaccaatcatttgccctagcttagtcatacggctcgtcgagaaggctagtcgcacttccattttgcgcaaatctaaacatttgtcctgtcgccaattctgggggaggcgagaattttaacggcgcgggaaatttttcattccaccaaaaaagcgagccaggaattaactcctagctcgctttgattgtgtaacgacattgttaccggtcagaaataaccacgtaggtgcattgaaccgggccgtggaccccaaccacgagttccatttcgatgtccccggagtttgacgggccggagatgatcgtgatcgcagacgtctttaagccctcagcgaaacggtgctcatagttaaccatcgcctggcgggtggaacgaaccaggccgctttgtggaaccagggcaacgtagtgggtggggaggaagttaaacccccggcccatttccggtcggttaaccacggtcaccgaaccggtggcggcgatcaggtagtcggctaacccgatggcgatgtcggcctggtcggcgttttgttcgttttgatcccggtcaagggtgggggaccaggtggcgacgtgctcgacccccgggttttgcgcccagccgtcgagttggtagtcggcccattcgctggcgtccacccccggtaacaagaggcgcttggcctggtcctggtgggctagctcggtcaggtagtcagccaactcggcgctcgacttaaccaccagttcggcgttgacgctctcgctgttttgcttggcggcgtctagcaactcagttggggttaggtcggcgagcatttgttccggtaggtcgttgagcggtttaaaggggtggtcggctaattgatggcgggaacgccccgactttttagccagccggtctaagaaggcctcccggttagcctggttgtttgcttggtctaataaactagtcatgttcggcctcctctaggtgttttttgacggccggggccaccgcggttggctggtggtccttaaaccagtgacggaagttgtcctttttcttgcttggcatcggtacgtcccgggagtcaacccagccgtggatcagcttcggcgtgatctttggcacgtggttaatcttaccgccctcatacatcccttccacgtcgcccggggccatttgcttggcaaacatcccggcgccggggtgagcgaaggtcaaagcggattggaagaggaacggtgagccggtaccgattccgatcaccttgaggatcaagttggtcatcgacttgtccatgtgcttgtcgtccatttcgacgatccggtgcttgcggatcaggctatggagcgggatccggaccgggcaggtttcggtgcaggccccacacagcgagcaagcataggggagttcttcaaacttctcgtagccgcccaggattggggagaggacttcacctagcgggccggggtagatggaaccgtagccctggccaccgatgtgacggtaaaccgggcacacgttcatgcaggccccacaacggatgcactgcagaatcggttcaaattcggtccccagggcgtcggaacggccgttatccaagacaacgacccagaagtcttcggggccatcgacttcgcccgccacctgcttgccggtaaaggtacagtaggtagttagcttttggcccacggcggagcgggctaacatgttgtccaagacctcggcttccttcatggttggcaccagccgttccatccccatgacgaccacttgggtcttggggatcgccatcgttaaatcggcgttcccttcgttggtgtctaagttgatcataccgttgctggcgatcgcgaagttacacccggtaattccgaagtcggcttgcatgaagtacttacgcaggtacccccggacgaagcgggcctcgtgttgcgggttgttatcgccgtcgtagccaagcttttggaattcgcgttggatctgatcccggttcttgtgcagggtcgggaaaacgatgtgggtgggttcgtcccagttgtcttcttgcaagatgaattcggccagatcactttccaagaggctggtccccggaatcgtcaacagggtcttatcaaggtcgatttcggtggttaccatcgacttggacttgacgatctttttggcctgcttttcgatcgccagctccttgatgaagttgcgggcctcttcttcggtttgggcgaagaaaacgtggcccccctggcgctcgacgttgttggagaattcctccaggtaatcgggcaggtacttgatgacgtgctggcggatctgttcggccaggtcgcgccactcgttccagtggcccatttcgcgccgggccgccgtccgcttgacgaactgggcgtcttgggccttggcgacggccgcccgcatgaacttgtcggcttcggcctcttccacccgcgtcatgtatggcttatcactcgttgaaattcccatttaaaagaccccctctccgctagccggaaccagctcttcgtcggtgtcggccaggtaggtgatccggttgacgtcgacgttgtggttcaaaacttcggcgatgtgcatgaccttgatgtgatcaccgttacggttcatgtaaccggcgatgttcatcaagcaagacggctccattccaatcaaaacttctgcttgggtttccatgatgtcagcggccttttctttgaccatttcatcggataattcggggtgcttggccgagaaggtccccccgaagccacagcacagctggacgtttttcagtggcacccgttgaatgtctttgacgtggtctaataagacgaagggcgccgtccgttcacccaacaagcgggtcatgtgacaggaccggtggaccgtcaccttggcgtcgagttcggccccgcagtcaacgacgccgaggacccggtaaataaactgggtaaactcgtaaatcttggcggccgcttccttggcgcggggaccgtaaaccgggtcgtcagccaggatttccgggtattccttgatcatgaagacgcaagagccggtaggacccacgatgtaatcggcatcgatactgagtagggcatcaatttcgtttttaaaggttttcatgctgcccttggagtagccactgttataggttggttgcccacaacaaacctgctgttcgggcaaaaaggtctcacaccccagccgctccaaaacctccaccatggcttggccgacgttaggaaacatcaggtccaccaggcaagaggagaaaatacaaactcgcggttgtttcattcgttacgcttagtcagtaccctggctaagcttccccctttcaatcagttcgcttaccttaatcgtaagcgctattttcataaataataattagggaaaagtcctaattacttatcgttcggtagttatagtctggggagtcctttcttgctaattagcgacgaaccgtggtagcatttgatggttaaaagatcggcgccccgctgttaacgaggaccgagcaaaaaattcatttaaatgggggtttcactcgtgaaaatcgggattgataagttggccttcgccacgacaccttactacttggcgatggaggacctggcccagggacgcaacgttgacccaaataagtatctgattgggattgggcaaagcaagcaggcggtggttccaccgacccaagacgtggtgaccttagcggcggcggcggccgacaagctcttggacccggttgaaagggatcaggtttccaccgtgatcgtggcgaccgaatccgggattgataattccaaggcggcggcggtttacgtcaagcacctattgaagttaagcgactttacccgggccgtggaagttaaggaggcctgctactcggcgacggctgccttgcaatttgcccgtggtttggtggccctcaacccccaagaaaagatcctggtgatcgccagcgacatcgcccgctacggcctggaaaccggcggcgaggtcacccagggggccggggcggtggcgatgctaatcaccgccaacccgcgggtcctggcaattgaaccaaccagcgtcgcctacaccaaggacgtgatggacttttggcggccactgtacgccgaagaagcgctggtcgacggcaagtactcgaccaacgtctacatcgactttttcaagcagtgctggatccgttaccagcagctggccggctacgggctagaggacttcgccgcgttggccttccacttgccgttcaccaagatgggcaagaaggccctggaggcggaattaggcgaccgggacgaccaagtggcgacccgcttgcgggctaacttgacggccggccaggaggcttgccgccaggttggcaacctctacaccggctccttatacctgggcttaatgtccttgttgacggaaggcgacgttaaaccgggcgagcggatcggactgttttcctatggttccggagcggaaggcgagttcttcgccgggatcttacaaccgggttaccaagaaggcctgggcgatttaaacgagcagttagccgcccggacccaggtgagcctggccgaatatgaagacctcttcaaccaacagttaggtttaaaggaagaagacgtcacctttaaaacgccggcggctggtcaacgctttgttttggtggggcaaaaggaccaccagcgccagtaccgggacctagccgagcgggattaataaataaaaatgcggctggaaagcgggttgctttccagccgcattttgagtttgaagtggggaatgagggctcaacggcctgtcgagaaggttgggtcgcacttccataacgtgctccccaaccgcaagcctagtggctaagtacggtcggagaacgatgcgtgccgcatcaacccccaccctagcttagcccacggcttgctttagaggttgggtcgcacttccataacgcgctccccaaccgcaagcctagtggctaagtctggccggagaacgatgcgtgccgcattaacccccgtcctatccttagcccacggcctgcccgatggttgggtcgcactcacttcctttaaaaaatatcatcccgaaagaggccgactaccttaccgaggatggtgacgtcatccaaaataattggggccaacgtgtcgttttccggttgcaagcggatgtggccctgttccttaaagaaacgcttgcaagtcgcttcgttatcgctggtcatggcgatcacgatgtcgccgttattggccgtttcctggcggcggacgatcaccttgtcgccgtttaggatcccaatgttgataatcgacgtcccctgaatggtcagcatgaacaagtcatcgtgatccgggatcgaaggcggaatcgggaagaaatcggtggcgtcttggaccgcaagaattggttccccagcggccaccacccccaggagggggatttgggtttgcttaggggtgattcccaggacttccagcccagccggggtgatttccagggcccggggcttggacgggtccttttttaggtagccctttttgatcaggcggttgatgtggccgtggaccgttgacgtggaagagagccccacggccccgcagatttcccgcacggtcggcgggtagccgtgggcgtcaacttgcttatgaatgaagctgagcacggccatttgtttgttggtggaattccttggcatgtttatttcctccgtattattgtgacctttattgcatattttaacataatgaacgggcgtttgtaaaacgtacgttcgaaaggggcgctccaacttgaaatggggcaacggattgggtagactgagaggcaaataagtaaaaaaggggtagcagaatggcagaatcacctgaacaagatcgcttactcaagcggatcaatgaattagcccacaagaacaagaccgagggcttaacgaccgctgaaaaggccgagcgcaaacgcttacgcgaccaatacctgaagaacttccgggcggcctttcgcagtaacatcgaaatgatgcaaatctttgataagaacggcaaggaactcacgccggaaaaggttaaggaaatccaacgtaagaaggggctccgcgacgactaggctaaaaagaattggtcaagtgggtcggtttgtgcaataattaagagtattgataaatttaaggggggaaatcaccgtgggtcttactattgccttagtaatccttgggatcctggttggggcattgatcggcttcttcggggcgcgccgttacatggaaaattaccttcgtaacaatccgccaatttccgaagacatgctgcggactatgatgcttcaaatgggccaaaagccgtctgaccgcaagttgcaccaaatgatgcaaacgatgaagagtcaggctaagcgtgccaaccgcaagtaagtgaaaacaaaaaaagggctccagcactgctcggcaagaccgaacggctggggccctttcatattagttagtcttttttcgtcttttttggtactacgtaatggtaggttgggtcgagttgcttatccagggcgtcaaaggcagtttggagttcttgttcgacctgggccaggttctcttcggtcagcttcatcttacggtcaatgtagattggcttaccaatggccaccttgcggcgttggcgcttgaagaggtccttgaaaaagagcggcccctggtagacggccggcacgagtggcacccccgccatcttggcaatcatcacggcgccgccctttaatttagaagagtagcgcgaccccgaggggaagatgatcgtcgacaggtcagtcttttttaacatcgtgaccggctttttgatcaccgagggacccgggttcttccggttcaccggaaaggcgttgagcttgcgcaagaagtagttggcaaacttacccttaaacagttcttctttggccatgaagcccagttttttggggtaaacggccagggccaaaaagatcgggtccatccaggtgcggtggggggccaccaacacgtagttgccctccggtaggtccactttgttagcaacgatttgccgcccgttaaacagggagatcaagggaccaaagaagtggactaaaaaactatacaacattgtcattcacctttatttaagctagattaagtatcggttatagtatgaagaagaattcgtcaacttgcaagttggattcaagagaggtgtggagcatggaacaagaagtgacgttaaaagctggcgaacggatcgaccagttatcgagccagggggttcagatcatccaatcaagcgaggtctttgccttctccctggacgcggtgttgttggcggcctttgtacgacccagccagaagcggcgggccctgttggtcgacctgtgcgccggcaacggggcggtcggcctctttttaaaccggcgctttgccgggcaggtggtggaagtcgaactccaacaacggctggctgacatggcggaccgctcgattcaattaaatgacttggcggaccgctaccaagtaattaacgccgacgttaaagacgtctaccagtacgtggccaaggaccaagccgacgtggtggtgtgcaacccaccctattttaaggaccaaccggcgagtcaaaaaaatcccaacccctacttggcgattgccaggcatgaactgaccattgacctggcaacggtgtgcgaccggatgagtgggctcttgaaaatgaacgggcacggctacttggtccaccgccccgaccgtttgaccgagattttagcgaccctggcggaccaccggctcgaacccaagcggatccagtttgtctaccccaaaccgggaatggacgccaacatggtcttaattgaagtgatcaaggacggcaagaccggcggcagcaaaatcatgcccggcttcttggtggccgacgcgagcggcgaatacaccccggcgatgaagaaggccctgtatgagtaagccttactacatctacgtcttgtactgtgccgaccagaccctgtactgtggctttaccgatgacgtaaaaaaacgggtggccacccaccaagcggggaagggcgccaagtacacccgggttaaaaaacgccaccccctgaccctgctctaccaagaagaattcgccgataaatcggccgctttaaaggccgagtacgcctttaaacaccagtcgcgccggcaaaaggaagcctatttactcgcccatggcgtgagcccggaaaaactgcaggggcgcttttgatttaatccttgcccaaaccgcaatgattgggtataatggttttcggtgttaaatccataattcacacccatccatgatggttcgggaagtgccaattggtgcccaagccgtgcgagtgaatggggaggaaaaaactatttggagggattatttatgcctgttgttagcatgaagcaattgcttgaagccggtgtccacttcggtcaccaaactcgtcgttggaaccctaagatgaagccattcatcttcacggaacggaacgggatctacattattgacctgcaaaagaccgttaagatgatcgacactgcctacaactacgttaaagacgtggctgccgacggtggggtggttctctttgttgggaccaagaagcaagcccaagattctatcgaagaagaagctacgcgtgccggtcaatactacgttaaccaccgctggttaggtggtaccttgaccaactggaagacgatccaatcccggatcagccgtctcaaggaactcaagaagatggccgaagatggtacttttgaccgtctgccaaagaaggaagttgctgttttaactaagcaacgcgaaaagctcgaacgcttcttgggcgggatcgaagacatgccacggatcccagatgtattgtacatcgtggacccgcataaggaacaaattgcggttaaggaagcccaaaagcttcacatcccgatcgttgccatggtcgacacgaacaccgacccagacgacatcgacgtaatcattccttctaacgacgacgcaattcgggccgttcgtctgatcactgccaagatggctgacgccgttatcgaaggcaagcaaggcgaagacgaccaacaagttgcctctgcagaagacgtagctgaagaagtttctgacgaatccttacaagatctgaagaacagcgtcgaaggcaacgactaacaaaatagttaatacttaggctgttttgcaaaaggacctatctggcctgagtgcaaagcggccttttttgaaaattaaggagagattctaatggctgaaattagtgcaaagcaagtgatggaactgcgcaagaagtccggtgccgggatcatggacgccaagaaggccctcgttgctagtgaaggtgacatggacaaggcaatggattaccttcgtgaaaaggggatcgctaaggccgctaagaagagcgaccggatcgccgctgaaggtttgactgacatcgtggtgaagggtaacaccgctgcgatcgttgaactgaactccgaaactgacttcgtggccgcttccgacccgttcaaggccgttttgaaggatgttgctaacctgatcgttgacaacaagccggccgacgtggaagccgccctggaattgaagacggctaacgggacgctcaacgatgacctgatcgccaccacccaaaagaccggtgaaaaggtcagcttgcgtcgcttcacgatcgttgaaaagaacgacaacgaaaactttggtgcttacctgcaccaaggtggccggatcgccgctttaacggtggttgaaggcgctgacgaagcaactgctaaggacgttgcaatgcacgttgctgccgttaacccagaattcctcgaccgcagcgaagtttccgacgaacgcctggaacacgaacgcggcatcttcaaggaagaaactttgaacgaaggcaagccagctaacatcgttgacaagatcgtggaaggccgcctcaacaagttcctctcccaaatctgcttggcagaccaagactttgttaaggacccagacctgacggttgaaaagtacgttgattccaaggacgggaagctcaagtccttcatccgttacgaagttggggaagggatcgaaaagaagcaaactaacctggctgaagaaatcaaagaacaactgaacaagtaattatcggttgaccgtggggggcgtacaatttcgtacgtccctttgtgcgaaaaacaggacccagaccaggaggatatggaatggctgacgtaaaatataagcgagtagtattgaagttaagtggggaagccctcgccggtgaccaaggctttgggatcaaccccccggaattaaagacggtggcaaaggaactcaaggaagtttacgccctgggagttcaagtagcaatcgttgtcggtggtggtaacatgtggcgcgggatcaccggtgaaaagctggggatggaacgtgcccaggccgattacattgggatgctcgggacgattatgaacgccctgtcacttcaagacgcgctggaagggatcggggtaccaacccgggtccaaacttccattgaaatgcgtcaaatcgctgaaccatacatccggcgcaaggccatccggcacctggaaaagaaccggattgtgatcttcgcgggggggacggggagcccgtacttctcaacggacactaccgctgccttgcgggccgccgaagtgaacgccgacgccatcttgatggctaaaaacggcgttgacggggtttactccgccgatccaaacaaggacgaatccgccgttaagtttgaacgactgacccacatggacatcatcgaaaagggcttgaacgtcatggactccacggcctcgaccctttcgatggacaacgacattccgctggtcgtcttcaacttgaacacgcctggtaacattttgaaagtggttcgcggtgataagattgggaccacgattgagggggaaaaataatgactggaaaagaaatcctcgcagaagcaaaggaaaagatggccaagtccggtgatgccttgaagcggaccttagccgacatccgggccggccgggccaacgcaagcctcttaaacacggtaacggttgaatactacggcgccccgacgccgcttaaccaactggcatcgatcacgatcccagaagcccgccaactgttgatctcgccgtacgacaagacgaccttaaaggacatcgaacgggccatttacgaatccaacctcggcttgacgccgcaaaacgacggggaaacgattcggctggtggttccgcaactgaccgaagaccgtcgtaaggaactggttaaagacgtgaaggcggaaatggaaaaggccaaggtggccgttcgtaacgttcgtcgggaagcgatggacgacctcaagaaggggaacaaggacggcgacttcaacgacgacgaattccacgacctggaaaagcaggtccaagaagaaaccgacgccggtatcaagaacctggaacaaatcgccgctgacaaggaaaaggaactgttggaaggctaagcagtttcggctcgccagctaaccccgcggggtggccggcgggcttttttcgttacgaaggtgagtagccccccgccctaatatctggtaagatgttgatgatgcgaaaattttctgaaatggagaatgaagatggattcacaaaaacaagtggaaccggttggtgagccggtgttagaccggagccgggttccgcaccacgttgccattatcatggacggcaatgggcgctgggcccagtcccgccacctcccgcgggtggccggccaccaacagggaatgcagacggtcaaaaaggtaaccatggccgctagcgacctggggattaaagccttaaccctctacgccttctcaacggaaaactggaaacgcccctcaactgaggtcaagttcttgatgcaactgccaatccgcttttttaatacctttgtcccggacctggtggcccataacgtccgggtgatggtgatgggtgacaccaccaagttgccggcggggacccaaaaggcggtgcaaggcgccctggatgcgaccaaggattgcaccgggatggtcttaaactttgccctaaactacggcgggcgtgacgaaatcgttcgggcgacccaggcggttgcaaagcgagtcgccgctggggagctgaccccggacgccatttccgaggagttgatttcccgggaaatgatgacggcgccgctcggtcaattcgccgaccccgaggtgattatccgcaccagcggggaagaacggcttagtaactttatgctctggcaggcggcctacagcgaattagtctttgttgacgaacactggcccgactttgacggtgactccctcaagcgggccttggccaccttccaatctcgtcaccgacgcttcggtggcttaaataataagtagaaacgaggtaacgtatttgaaaacacgggttattacggcggtgatcgccttaattgtatttatcccgctgattatcgtcggtagctggcctttgatgctggctgccatcgtcttgggaatggtcgccatgagcgaactgctcttgatgaagaagatgtttttgatctcctttgaggcgattgtttcctacctgggggtggcggcgatgatcgtgccccagacctggctggactttttgccggagcaaattggccggctcaccctggtttacgtaatggtggctcttctactcttacacaccgtcattcgtaagcaacggtttaactttgacgacgccggggttttgaccctcgggatgctctacatcgggatgggctttaacgcctttaccgttgcccgggccgtcaacttccaaaccctcttgtacgggatgctaattgtctggttaaccgactccggggcctacctgtttgggcgccagttcggtaagcacaagttagccccgaacgtcagccccaacaaaacctgggaagggtccgtcttagggacggtagcggcgaccgtcattttggccgtctacttgaccttcttcccggttggttacgacaacttagcggtcatgatcgtcttgaccctgcttttgtcgatcctcggtcagttcggcgacctggtcgaatcggccctcaaacggtactatggggtcaaagattccggtaagatcctgcccgggcacggggggatcttggaccggtttgattccatgctactggtcttgccggccatggcgctgctgggcattctctagtctagcgaagggagtgattctttgatcatcaccatcattacttttatcatcgtcttcggaatcctggtgctcgttcacgaattcggccactactactttgccaagcgggccgggattttggtgcgcgagttttcgattgggatggggcccaaggtttggtggcggcgttcaaacgggacgacctacaccatccggatcctgccgcttgggggctacgtccgcctggccgggaccgatgaagatgaagacgaactccgtcccgggacgccggtgaccttgcaaaccaatgaggaaggcaaggtgaccctgattaacgccagcgaaaaggaaaccctgttggaggggattccgctgcggatcgttgacagcgacctggaggataagttaatcatctccgggtacgaaaatgatgatgaagaaaccgtcaagacctacccggttgatcacgacgcgacgatcgtcgaacgggacgggaccgaggtgcggatcgcccccaaggacgttcagttccaatcggccagcttaccggcgcggatgatgaccaactttgccgggccaatgaacaacttcatcttgtccctgctggtcttcatcatcctgggctttaccctgagcgggatccccaccaactccaacgttttgggcggggtgaccaaggattcggtggctgccaaggccggcctggtgagcggcgataaaattaccagggtggcgacgaccaaggtcagcacctggaacgatatttcccaggcaatttcccctaacccggggaagaagctcgccgttacctaccagcgcgatggcaagacctaccacaccaccgtgacgcctaaggccaccaaacaggggagccaaacggtcgggatgatcggaatcagagaagaggagaagtttgatccggtcgcccgcattaactacggctggcgccaatttatcaccgccggcaccctgatctttgcggtgctcggccacatgattacgcacggctttagcttaaacgacctgggggggccggtggcaatttacgccggcacctcgcaggccacctcgttagggattaacggcatcctcgccttcttggcgatgctgtcgattaacctagggatcgttaacctgattccgatcccggccttagacggggggaagctcctcttaaacattgtcgaaggcatcattcgccggccaattcccgaaaaagtggaggggattttgaatttggctggctttgccatcttgatgatcctgatggtccttgtgacctataacgacattcaacgctactttatccattaacaaatttttttgaagaagaaggagaatcgatttatgaagcagtcaaagatgctgattccaacccaaaaggaagcaccggcagacgccgaagtcttatcccacaagatgatggtccgggcgggctatatctaccaagtttccgccggggtgtgggcctacttgccgttggcctaccgggtcatccgtaagattgaacaaatcatccgcgaggaaatggacaaggccggggcggtcgaaatgctcctgccgggactcttgccggccgacttatggagggaatctggccgttacgaggcatacggggacaacctgtttaagttaaaggaccgccgggaacgcgactttatcctggggccgacccacgaagaaacggtcacctccatcctgcgtgacgccatccactcctacaagaagctgccgctggtcgtttaccaactacaagataagtaccgcgacgaggaccggccgcgttacgggatcttgcggggcaaggaatttgaaatgctcgacggttactccttctctgccgatcaagccggcttagaccaggcttacgatctgcaagctaaggcctaccgcaacatctttgaccggattggccttgattacaaggtgatcttagccgattccgggacgatggggggcaagaactcccaagaattctccgccccggccgcaattggtgaagacgtgattgcctacacggacggcgattacgccgccaacctggaaaaggcaaccaccaagttcaccccgacgaagcaaatcggtgaagaggccgaattgaccaagaaggcgaccccgggcgcccacacggttgacgaagccgccgaaagcctgggcctggaagccagccaaatcttaaagagcatggtcttcttagccaagtttgaaggcgaagagcttaagccggtgatggttctgatgcggggcaacgacgaggttaacgaaaccaaggtcgcttcttacctgggctgcgaagaattgttgatggcctccgaagaagacaccgaaaagtacctaggcgcacacccgggctccttgggaccgatcggggtcaaagaagacgtcaccatcctggctgaccaacacctgcaggggatgattaacatggccctgggtgctaacgacgatggttaccactacatcaacgccaacttcaaccgcgactttaaggtggatcagtttggtgacttccggaccgttcaagaaggtgaaacggcgccggacggtttaccaatcaagttcaccaacgggatcgaaattggtcacatcttcaagctggggacccactactccgaggtctttggggcgacggtgctggaccaaaatggccgcgacgtgccgatgatcatgggttgctacgggatcggggtttcccgcctgctgtccgccatttccgaacaaaacgccgacgaaaacgggctggtgtggccgcaagccgtggcaccgtttgacatccacgtgattccagttaacgccaagaaggaagaccagatggccatggccgaagaaattacggccaacctagaagaggccggctacgaagtcctcgttgacgaccgcaaggaacgggccggggtcaagtttgccgacgccgacttgatcggggtgccgatccgggtcacggtcggtaagaaggccggcgaagggatcgtggaaatcaagatccgcaagaccggtgaaaccttggaagtgcacaaggaagaattggccaccaacatcgccatcttgcttaagcaaacggctgaataacaagcgaaagtggttcggggatttcaccggccacttttgttttttcttgcattcacccagtaagatgttagaatttagtttgcgaacaaacgtttgaaagagtgcgccctgacggcgtgttagaaagaggagggattttgtggccctaagcaaacaggaacagtttgaaaagttactggagcaaattgactatgccgacccccacttaacgggcggggcgattgaccaagtggtggttcaccagcagtcacgggtgtgggagttgcaccttcacttaagggaggtcttgccgctagccgtcttcacccagctggaacaaaaaacggcggtttcctttcaccaactggctaaggcccaggtccgctttgagatcacgaccgaccaaggggagctggtcccaaacttgattagcgactactggccttacgtggtccggatggtggccggcaattcgccgatggcccaggaaatctgcttaaagacctcgccggagctcgacgacgggcgggtgagcctgctgatggaaaacgaggccgtcgaacagatctttgccaccaagctcctaggcaagatcgaggagggctaccagcaggtgggctttccggcctttcatatccacaccctggtcgaccagagtgcgtcccaagccaagattgaggaattaaaggccaagcaacaaaaggccgacgaggagctggttaaacaggcccgcacccagatcgaacaagccaagcaaaagcaacaggcgaccgccagtgcggcccccgacggcccaattgtgatcggcagaaagctcgggccgaacgatcaggtgacccggatggccacgatcaccgaagaggagagccaggtggtcgtcgaagggtacgtctttgccaaggagatcaaggaactgcgctcggagcgccagatcctgatcctagagattaccgattacacctcctcgttttcggttaagatgttctccgaccggcgggggaccaataagccgctctttgccgccctggaaaaggggatgtgggtcaaggtccgcggttcggtgcaagaagacacctacatgcgcgacctggtgattaacgcccgcgacattaacgaggtctcccaccaggaacgccaggacacggcgccggccgaccaaaagcggattgagttacacctccacaccaccatgtcgacgatggacgccaccaacacgatcggcgaatacgttaagcaggcgattaagtggggccaaccggcgatcgccattaccgatcacgccggcttacagggcttcccggaggcctttagctcctcgtacgacgggaaaaaggacgaaagcaagattaagatgctctacggcgtcgaggccaacgtggttgatgacggggtgccgctggtttataacgaaaaccacctgccgctcaagggccagccctacgtgatcttcgacattgaaacgaccgggctgtcggccatctacgaccggatcatccaagtttcggccgtcaagatgcaagatggcgaggtcttagaccacttcgaccaattcatcgacccgggcttccacctgtcggaacaaacgaccgccctgacctcgatcaccgacgacatggtgcaggggtccaagaccgaagaagaggttctcaagctctttgacgactttgcggacggctcgctgttagccgggcacaacgtctcctttgatatgggctttatgaacgtggcctacgaacggcacgggatggggcaaatcaagcagccggtcatcgacaccttgccgctggcccgcttcttgcacccggactttcgcggttaccgcttgaacaccctgagcaagcgctttaaggtctccttggagcaccaccacttggcctcttacgactccgaagccaccggccacttgctggcgatctttttaaaggacgccgaggagcgctacggggtgacctacgtcgacgacttgaacaagcatatgactgacaacggggcttaccgccatgcccggccgttccacgtcaccatcttggcggcgacccaggctggcttgaagaacctttacaagctagtttctttgtccaacgtcgagtactttgcccgggtaccccggattccgcgttcggttttgaaccgctaccgggaggggctcttgctcgggaccgcctgtgccgacggggaagtcttcaccgccatgatgcaaaagggttacggcgaggccaaacggttggcagaattttacgattacatcgaggtccagcccaagcctaattatgctccgctgttagagagtggcgtgatcacggatcaggcccacttagaagacatcttaaagaacatggtaaaactcggcagcgccctgaataagccggtcgtggccaccggggacgcccactacattaaccccgaagacgccatttaccgtaagattctgatcaactcccaggggggtgccaaccccttgaaccggaccgagcgccccgacgtgcacttccggaccaccgacgagatgctcgacctcttctccttcctgggcgaggacgtcgccaagcagattgtcgttgataacacccacctggttgccgacatggtcgacgacgggatccgcccggttaaggccggcttgtacccgccgcacatggagggggccgaacaagaaattcaggaccggacctggacgacggccaaggaatggtacggtgacccgctgccgcaactggttaaggaccgggttgaattggaactgaactcgatcgtttccaacgggttctcggtccactacttgatcgcccagcgcctggtggccaagtcaactaaggacggctacctggtcgggtcacgggggtcggtcggctccagtgtggtcgccactttgtctgggatcaccgaggttaacccactgccgccgcactaccgctgcccgaactgtcagtactcgcacttttacaccaagggggaatactcctcgggctttgacttgcccgacaaggactgcccgaagtgtgggaccaagatgattggtgacggccacgacatccccttccaaaccttcttgggctttaaggggaataaggttccggatatcgatttgaacttctcaggggactaccaaccgatcgcccacaactacatgaaggtcttgttcggtgaaaataacgtttaccgggccggcacgatcgggacggtcgccgataagaccgcctacggttacgtcaaggcctacgaacgcgacaaggaagttcagttccgcggcgccgaagaggaccggctggccagcggggcgaccggggtcaagcggacgaccggccagcacccggccgggatcatcatcgtgcccgacgacatggaaatttacgacttcacgccggttcagtacccggccgacgaccaatcggcggcctgggaaacgacccacttcgatttccactcgatccacgacaatattttgaagatggacatcctgggccacgatgacccaaccatgatccgggccctccaggacctgtcggggatcaacccgcagtcgatcccgatggacgaccccggggtgatgagcctcttctccagccccgaagcgctcggggtgaccgaagaacagatcaactccaagaccgggacgctcgggctgcccgaatttgggacccgctttgtgcgggggatgctagaagacacccacccgcaaaactattcccaactcctgcaaatttccgggctctcccacgggaccggggtgtggctcgataacgcccaggaactgattaaaaacggcaccgccacgattgccaacgtgatcgggtgccgggataacatcatgaccgacttgatccactacgggttggattcggaaacctctttccaggtcatggaacacgtccgtaagggaaaggggatccccgaagagtggcaagagaagatgaccgaagtcggcgtgccgcagtggtacctcgactcgtgtttgaagatcaagtacatgttcccgcgggcccacgcggccgcctatgtcttgatggccctgcggattgcctactttaaggtctacttcccgctggtttactacgccgccttcttctctgtgcgggccgatgactttgacgtcgtcgccatgagccacggcaaggaagccgttaagtcagcgatgcaagcaattaccagcaagggcaacgaagccacggccaaggaaaagtcactgctgacgatcctggagctggctaacgaaatgctggagcggggctttaagtttaagatggtcgacatcgaacgctccgacgccaccgactggttaattgatggcgacaccctgattgcgccgttccgggcgatcccgggactggggatcaacgtggccaagcagatcgtggccgcccgggaggaaaagcccttcttgtccaagcaagacctctccgaacgggggaaggtctccaagaccttgatcgagtttatgaccgtcaaccacgtcttagaccaactcccagacgaaaaccagctgtccttgtttgacatgctgtaatgggagtggcaactaacctcctcggcgggtcggctggctaagctaaggcaagggttagcgactacattaatatctgcgaataaaaaagaggcgatggcaaatttgtcatcgtctctttttgtttaagcagtcgtagttacagcgctttctaagacatccgtaatcatgtccagccccttctttagatcgtgttcggtcattaccaaaggtggcaagaggcgaagagtgttgtgcttggccgacagggttaagaggccctttgcttgcagttgggtgatgacgtcattgacgtcgaccaccgggcttaggtgaacgccaatcatcaagccgagacccgagatgctttcgaccgccggcagggtgtctatcttttcatttaggtagttccaaacgctggcggccttttcgtcaaccatcgctaaaaacgacggggttagctgctgtaagacccccttggccgctgccaaggaaagtttgttgccgccaaaggtggtcccttgcgaaccggggccaaaggtggcggcgaacttctttttgccgagcatcaccccgagtggcagaccgttgccgattcccttggcgaccgtgaccacatcgggattcaggttgtaatgctggtaagcgaacttcttgcccgtccgcccgatcccggtttggacttcgtcgataatcaagagggcgccggcttggtggcaggcggtttggaccttggtcaaccagtctggcttaccgttgatgaccccaccttcgccctggacgacttccaagatcacgccggcggtttggtcgtcaattaaggagagggccgaattgctgttgtaatcgccaaaggtgacgtccgggaccagcggggcgtaaccaaccttaatcgccccgttaccagttaaggacatcgccccgtaagtccgaccgtggaaactgttgtgaaaggtgaccattttggagcgcccggttgtcttacgggcgaacttcattgcggcctcgttagcctcggtgcccgagttgcagaaaaaggctagcttgtcgggaccggcaaggaggccggcgacatcttcggtcaattggctttggtaaaggttagaggtgtgccaaatcttggtggcttgctcgaaaacgttatcggtgatttgctcgttgctgtagccaaagttacaaaccccgatcccgctggtgaagtcaaggtaggtctgaccgtttttatcggtgaggtgccagtcgtggccggcaacgatgtcaatggggtattggttgtaggtattaaaaatattactcatgggctgctccttttaagcgctgacctggtgggccagggcggtccctgactgggtgaggtcattagtgattgaaacgttagcaacgcccctctttagggcggaaaaagcggcggttagtttcggcatcataccggccgtgatttggtggtgggcgaagagttggttggcaccggtctgatcaaggcgtggcaagaccttgccagcctttaagaccccgggcacgtcggttaagaggacgagcttgctggcgccaagtcgggtggcaatttcggcggcggccgtgtcagcgttaacgtttaagagttgaccgctggctgtttgggccaacggggctaagacgccaatttcgttggtcaaaagttggtccagccatgcctgattgaccccggtgatctggccgacctcaccaaagtggggctggtcgaggtaattaccagctagtaagtggtggtcgttagtgtttaggccaaccacggggaggtggtgagtggtcaactggtggcacagggccggttgaaccacccctaataagacggcttgaatcacttctaggcaggctggggtggtaacccggaccccgtcttccttgtggttaggcagcttcatcaggtccagccactggctaatctggggtccgccgccgtggatgatcaagacgtgtttttcctgggcgcgccacttggcaagttggtggtagaactggtcgtctaagagtttactggcgtggccgccaactttgataacgatggtctctgtcataagcccctcctagttgtggtacgaggcgttgatcttgacgtactggtaggtcaggtcacacccccaggcctggccgagcgccttgccgttatggaggtcgactttaacgtttacctggttttcgtggaggtggctggcaaccacctgtgggtcaatcagataggcctgactgtccttgacgacgggttggtcgttgagccaaacgtcaacgtggttggtgtccaagtgggccttggtttgtccaattgcccccatcaggcgcccccagttcgggtcctcgccgaagatggcggccttgaccaggttagagccgacaatggccttagccaccatttgggcttcgtcgtggttgtaggcgtgcaagacgtcggcttcgactaacttggtcgccccttcgccatccttagcaatcgacttggctaagaaactcagcacctggtggaaggcggcggcaaagagggcgtagccagccggatctgccgttactggtgaggtttgggccatcccgttggccaagaccagtaccatgtcgttggtggaggtgtcgccatcaaccgtgatctggttgaaggtttcgtcaacctgctggtttaacagctgctgtagggccaccccgtcaatcttagcgtcggtggtcacaaagcctagcatggtcgccatcttggggtggatcattcccgaccccttggcaaagccggtcacggtgactggttcgttattgaactcaaactggacgctgatcgacttggggtgcttgtcggtggtcaaaaccgcctcggtcacggcggcggacttggttaggctgagttggctaatcccgtttgtgatcttatccattggtagtggttcgccgatgatcccagttgaggccacgccgaccaactgatcggttaagcccagcttcttggctgctaggtgttgcattgttttggcgttaaccaggccctggggcccggtgcaagaattagcgttagcgctgttcataaccaccgcttggagttggtgggccaagttgacggtttgcttcgttagcttggtcggggcggcttggaactggttggtggtgtagaccccggcggcagcggccggcaccttggaatatagccagcccaggtcctttttttcttccttcagaccagcgtgtatcccgtcggcataaaaacccttgggccaagtgaaagtggttaaggtgttaatttcgtgtttagtcatggtaacaattcctttctcttttgaagctacggcaggaggggagccgtcggtaaaccagcggtcggtgcgaagttaaaacgttggttgaagttttggattgcctggccaccggcgcccttaatcaggttgtcaattacgctggccaccatgatcgtgttggcgtgctcgttgaacaagacccccaggtcgcagtagttggtaccgaccacttgcttaatggtgggtaagttttcaccggtataacggacaaaggggtcggtcgcgtaggtttgtttaaaggcagccgccacctgatccttgttaacgcccggtttgggtttagcgtaaatggtcgctaggattccgcgggtaatcggtaagagggtggtgctgaattggatagcatcaacggccggatcccaagcttgcagttgttgaacaatttcggggatgtgcttgtggtgattgacgttatacagctgggcgttttcattaacctgagtaaagtgagtgcttgacgtcggctttttgccggcgccagaggttcccgacttggcgtcgaccacaatggtatcaaggtcgatcagctggtcgatgatgagtggtgccaagcccaagagggtcgccgttgcgtaacaacctgggttggcaatcaaattctcgtcagtagcgtcacagaagtcggtcagaccgtagtgggcgactttgaggtcggcggtggcggccggggattggtggtaccacttctcataggtggccccgtttttcagtcggtagtcgccagagaggtcgattactgggaagtgggcggttaaatatggtcgggcagcggtcttcgtgacaccggctggggtggcaaaaaagaccgccccgtcgttagctaagattttttggctgtcgtaggggtacaccggttggtcatcaaataaattagggaccaactgattcaagggcgtcgggccagccaagtggcgggcgtagagatcaacttggtcgatccccgggtgggttttaagcatttggtagaggaccatcccgccgtagccggtgatcccgattagggcaactttcatcttcttcatctcttttatacaagttttataagttttttgtgattgctaacagcctacaacgtggtgaccggattagcaagaacttttttatttttatccagaaaatacggataaaatgcgttaaatgttcataaataaccaataaattccgctattttaaaattactccttgcgtggcgagtgaaagggcgttatgatcgtcactaaatatttatacacataaaacgaataaaggagccgttaaaatgaataaatacctcatcttagaggacgggaccacctacccggggaccgcctttggggacctgggggcgcaagtggccggagagttggtgtttaacaccgccatgactggctaccaagcatccctgaccgatccatcctacttaaaccaactactaacctttactaaccccctaatcggtacttacggtatttggcccggccaaagtcaaagcaagcaagtgaccgctggtgccgtgatcgtccgtcagctcgaaaacgaaccgggaccgactggccagaccttggatgcttggttagtcgaccatcacgtgccgggaattgagggtgttgacacccgggcgattgccatgcacttacgcgaagacggcaccattaagaccctgctagttaatcagctggtgaccccaactgagtttacgaacttatatagccggttggtcggccagcagaaacttcccgctcgaaacgctggtgctacggacccaaccgccaacctgaccgttgccctgatcgatcttggggtgaagcaggggattattgataatttagtggactgtgggtgtcgagtcgtcgtcttaccaccatcggcggcggtcgccgaggtccatgagctcaacccggccggggtcttgatttcaaatggtcccggcgatccgctggactaccaggcggtcttacccctaattcgaggtttggaacacgactacccgctggcgggaatctgtttgggacaccaattgttagccctagctaatggtgcaaccacttatcggctgccttttggccaccggggggctaatcacccggtgacgctgttggcctcacagcaaacgatcatgaccagtcaaaaccatggctatgccgttgatcccaccagcctcaagaagaccggcttaaaggtaactgccgttgagggcaacgaccacacggtagaggggctaaccttggttggctacccggtcatttcggtccagtttcacccagaggccgggccgggcccaaacgacgcccggaactttttcagtcactttaaacagttaatggaaacgggggtggcggtcaatgcctaagagaacggatttacacaagatcttagtgatcgggtcgggaccaattgtgatcggtcaagccgctgagtttgattacgctggcagccaggcctgcatcagccttaaggaagagggttatcaggtggtcttggtcaattccaatccagctacgatcatgacggacgatcaaattgctgaccaagtctacttggagccactgacggtaccgtcattaaccgagattattgaactggagcaccccgacgccctcttgccaaccctgggcgggcaaaccggtctgaaccttgccatcgagctcgaccaagccggcgtcttaaataagttcggtgtcactcttttaggcaccgatttacaaacgatccaggaggccgaagaccgagagcaatttaagcagttaatggaggagattgggcaaccggtaccggcgagcctaaccgttcacactgtcgaggcagcttgtcagtttgccgaagaagcgggctacccagtaatcgttcgaccggccttcactcttgggggaaccggaggcgggatcgccaacgaccaggaagagcttgagctgattgctaaacgggggctagctcagtcgccggtcacggaatgcctgattgagcaaagtatcgccggcttaaaggaaattgagtttgaagtaatgcgcgatgccaacggggacgagataagtgtttgttgcatggaaaatttcgacccggtcggtattcacactggtgattcaatcgtagtggcgcccaaccaaaccctgccggatgttcagtaccaacggcttcggtcagcagccctagcgatcgtagccgccctaaagattgaagggggctgcaacgttcaactggcccagtcaccgattagtgatgattattacgtgattgaggttaacccgcgggttagccgttcgtcggccctcgcctccaaagcgactggctacccgatcgccaagattgccgctaagatcgccgttggccttaacttgagtgaaatcaccaatccggttacccagaccacaatcgctgccttcgagccagccctcgactacgtagttgttaagttaccgcgcttcccctttgacaaattcggtggagccgatcgccacttagggactcaaatgaaggcaaccggggaggtgatgggcatcggtctaacctttgaagaggcgctcttaaaggcaattgactcgctggaaattgaccctggggttcaggcgagcctcctgccggctaacgatgatcagctaagcgaccaggaattggtggcagctcttaaatcaccaactgacctgcgactgtttgagctcttcgtcgcccttaaacggggatattcaaccgctgacttagcggaatggaccaagatcagccccttcttcttgcacaagctggcccacatttggcaactaaagcgggaattagtatcgcaggggggagaggtagtggttagtgccaagcggtttggctttaccaacgccatgctcgccagtgcgctccgatgttcgttgtcgaccgttgagcagctagttaaaagtgcggggttagccccggtttacaagaccgtagatacctgtgccggggagtttgctagtgcgaccccgtactattacagcagttatttcccgggcaataacgagagtcagccactgggcaatagtgggctataatccccttaagggtgacacttgaaataataaaagtgttatttccttaagggggtttttgcatttcaagttattcgacaatgaatagactagagttgctttatggctatcaaaagacagaatccggcctcaaagtatatgccgatatgcatcatgtcaatcagaatacgatgacaagatggattcggcagtttctcttgcatggtttggcgggagttcgccatcgttcactcaatcatcgctatttactaaataccaagattgaagctgtcaaagagtatcaagccggtttcccaggtgaaaaaatcattgaaaagtatgatattcgtagtctctctcaactaaaacagtggtcgatccagtacaataatgatgaactaaagactaagtcaagaaagcgagtcagaaaaatgggtcgaaaagttagttttgaagagaaatgcaaaatcgtacagtgggtcttggaccatgacaatgactaccaaggagcaacgattcagtttaatgtaagctatcagcgtgtctactcatgggttcacaaataccatgaggcagctgacagttgggaagccttgaaagataatcgcgggcatcgcaagccacaaaaagctttagaagagatgaccgaaaaagagcgacttgaagctgaaattaaaagactaaagaaaatcaatcgagaaatggagcttgagatcgcattcgcaaaaaaattagtcgaaatacgcaatcggggggtgaagagaccggacgatatcaagcggttcaagaattaatcaacgaaaccgcaggttccgttagcgaactgactaaaattgccaaagtttcacgcaaatcatactatcagtggctcaaaagacagccaacacaaagagaaattgagaacaaggcaattttggaagcaatctatcagattgaaaaacgccatcagaactgtgctggttataaaaaagtaaccgcgattttaaacaatgagaataggaaaaatcaagaaattccagaatacaccttttcgtttgactttcgtatcaatattaagcgtgtgcgtcgaatcatgcggaaacacggcattaaagctgatgtccgtcaaaaaaagcgcagccgcaagaaagaacaacaacagtaccaagaggataatttattggaacggaaatttattcagatagcgcctaatctggtttgggtgtccgatactacagaactaacctatggtcgcaacaataaagttcgcttgcacgtagttttggatttgtatggtcgttacgtgctcagttatcatatttcaccaactgagacagcagaagccgcaattgaagcctttaaacgcgccgctaagcaggctgggaccttcgcaccattgattcataccgatcgtggcgctgcctatacttcaaaagacttcaataactatttaaccagcaacaatagtaagcatagtctctctgcgcccggtactccggctgataacgcagtaattgagcactattggggcgattttaagtacatctggatgacgcatcatccacatccgcaaaccttgacagaactgaaagatttggttaagcagggtgttgagtacttcaacacagtcgagatttccagcaagcgaaataacctcaccgcggaggacttccgcaatgaggccgtatagactaattttttatttttttaagtgttaccttgacagggtacagtaccagtgtgttagtgcttggttctggtccaattcggattggtcagggggtcgaatttgattacacgaccgtccactgcgttcaagcgattcaagaggccggctaccgtgcgatcattatcaataacaatcccgaaacggtttcgaccgatttttcaatttccgacaaactctactttgaaccgctgacgattgagcacgtcatgaacgtggtcaacctagagcagccacgcggggtgatcgttcagtttgggggtcaaacggccattaacctgaccaaggaactggttaaacggggggttaaaattctgggcacctcactccaggggattgaacagaccgaggaccgccaccagtttgaggaattactcaaggacgctggaatcgcccaaccaaagggggccacggcgctcaatttagccgaggccaaggtgattgcaccggtggttggctatccggtaatggtgcggccaagcttcgtgctgggtggtcgggcaatggcggtcgtggaaaacgaaaccgaattggtaacctacgtcaacaaggccctgaaggcggcccccaaccaaccggttctgattgatcactatgtagctgggcttgagtgcgaagtcgacatcttaagcgacggtcacgacgttttgatccccgggatcatggagcatttggaggggtccgggattcactcgggtgattcgatggccctgtacccaccagttcgcctgacgtcagcccagcaaaaagaaattgttcaaactgcgattgcaattggtcaacgggtccactgtctgggaatgatgaacattcaattcatcgttgccgaccgggtctatgtgattgaagtcaacccgcgggccagccggacggtaccgtttatgagtaaggtgactgggtatcacttagccaagctagctacccggctaatcctgggtgaaaccttggtcgacttaggtttaccaagtggtttagcaaccccaagtaaccacttcgccgtcaaagcgccggtcttttcctttgctaagttggccggacttacttgccggttggcgccggaaatgaagtcaactggggaaacaattggaattgatgaaagcccggccgtagctttggccaaggcgcttgctaatagttatggcttagtaacgccggtgaagggtcaaatcgtcttacttgacccagttgccgctactaactctaaattacgggctcaacttgaacaagcggggctccgggtcgaggtctgggcaagccagcaattgccaacgctggaacaccaacgggtctgggcagtggttaatgatgacgaagcgcaaaccacgatagcaccattgaactactacgccctgagtaacggggtgcccctctttacggcggccaccagccttagtgaaatcatgtcgttaagcagggtgggggcgccgctggttaatttataaaaaggactaaaatttagccctgaaaagagatcgctggtcgccaagcttgtcagggcgggcaaagaatggtatattagtatttgaaataactcgttgagggggtgagcagaaatgctcgctctttttattgtaatgaaacgggaggtgacgagatgagtaataagactgtagtcgagaccgtaacggcgctggtggaaccaatcttagctgaacacaactttgaactgtacgaagttgaattcgtccaggaagccaagagctggtatttgcgggtctacatcgataaggaaggcggcatcacgctggaagattgtgcccttgtcagcgaccagttgagcgaacaactggacagcgccgatccagacccgatcccccaggcctacttcttggaagtttcttcgccaggggctgaacggccgctgaaaaaagaagtggactaccaacgggcccttgaccaatacgtgaacgtttctttgtaccaacaaattgacggccacaaggtgtttgaagggtatcttcgccaattgagcccggatgagttaaccattgagtacatggataaaacccgccaaaagcaggttgtaatcccgcgggacaaggttgccaaggcccgcttagcgattaagttttaagagttgaaggagtcgaaaaatgagcaagaaggaagaccgggtagaactactcgacgcgatggacatcctggaaaaggaaaagggaatcaaaaaagaggtcatcattgaggccttaaaggacgccctggccaacgcctaccaaaagaattacgaagacaacgcggccaacgtggaagtcgaaatcagtgaccggaccggtgaatttaaggtctacgccgctaagacggtggttgaagaagtcactaacgacgtggaagaaatttctttggccgacgcattgcgggttaaccgcggttacgaactgggtgatatcttcaaagaagaagtgacgccgcgcaacttcggtcgtctggctgcccaaaccgccaagagcgtggtgttgcaaaagctacgggacgaagaacgaaacatcatctttgacaagtacaacaagttaaaggatgatttagtcgaaggggaagtctcacgagaagacgaacgctacatctacgtcaacctcggtgacggtgtggaagcggccatgaacaagcatgaccaaatgccaaacgagcactaccgggtgcacgaccggatccaagtttacgtgacccgggtcaacgacaagagcggcgcccgcgggccgttggtcttcgtttcccggaccagtccggacctgctcaagcggctctttgaaaaggaagtgccggaaattcaacaggggatcgtggaagttaaggggatcgtgcgtgaagccggtgaccgggccaaggtggccgtcttctcccgcgacgaaaacgttgacccagtcgggacttgcgtgggaccacgcgggacccgggttcaggcgatcgtcaaccaactgggcggcgaaaacatcgacatcgttaagtacgaagaggcgccggaagaatttatccgcaacgccctgaacccggccgaagtcgaaggggtgctcttcgatgaaaacaacggggaagtcgatgaaccggctagcgtcgacgaaaacggtcgcgaacacgaggaacggatccaccgtggttgcaccgtgatcgtaccggacgaccaactgtcactggcgatcggtaagcgggggcaaaacgttcgcttagccgcacagctgaccggctacaagatcgacatcaagtcgtcatcccaagcggcggccctggaagaagcgcaaccagaaccagcagcagaagttgtagagcagccaacccaagccccagagcttgaccaagccgctgacagcttcgcagacgaagactagacttaatccttatcaagaaagcaacggggtgaaaaaatggttaaaaagaaaaaaataccgatgcgtaaggatatcgtgaccggagaaatggtgcccaagcgagaattaatccgggtcgttaagaacaaggaaaacgaagtatcgcttgacccaaccggcaaaaagccggggcggggtgcctacgttgccgtgagcgtagcggttgcccaaaaggctaagaaggaacggacctttgacaaggcctttggcgtaacgctcactgacgaattttacgatgagttaattcaatacgctgatcaccaacaagcacgccaagagctgttcggtaagaatgattaatcagcgtcagcaaattttaaacctcctcgggcttgcccggcgcgcgggacagctagtgactggtgaagggatggtcttaaccgcccttcaaaaagaccaggtgcggattgtcttgctcgcaagtgacgccggccaggcaaccattaaaaaggtgaccgataagtgtcaaacccaccaagtacgggtggttaacgattttacccggctggaaattagccaggcaatcggccaggcgcgcacgatcgtgggaattaccggggcagggtttgcaaagaaaatccatcaattaacaaccaaactaaatgagggagagtgagcgtatggccaaagaaagaatttacgaattagctaaagagctcaaaatgccaagcaaggacctggttaacttagccaaaaaggaggggatggacgttaagacccacatgtcttctgtcacttccgacgaagccaacaagctgcgttcaatggccaagggggcgggtaagccagctgctgttaagccggcaccaaaggtccaagaacaccagtcggccccggcgaagaaggaagccagccgtccggccaaccaaggcagccaaaacaaccagaaccgcgacaaccgggggaaccggaacaacaacggcaacaataaccgccacaacagcaataacggttccgctaatgctaacggtaacggcggcaaccaaaagcggaaccaaaagcggaaccaaaacaacaataaccagggtggccaagccgctaaccggaacaataacaacggtcaaggtcagggtgcacactggtttaaaaagggtaagaagaacaacaagaagaagaaccgtaacaaggggaaccaacgcctgcgcgacacggctcctaaggccccaacccaacgcaaggatcggccgctgccggacgtattggaatacacgaacggcatgaacgcccaggacctcgggaagatcttgcaccggtcaccagccgaaatcatcaagaagctcttcatgttaggggtgatggtgaaccaaaaccaatccctggatgcggacacgattgaaattttggcggccgactacgggatcggagccaaggaaaaggtccaagtcgacgtagcggacttagaccacttctttgacgaacggatcaacaacgacgccaacctcgccgaccggccaccggttgtgacggtcatggggcacgttgaccacgggaagacgaccttgctagacaagattcgtcactcccacgtgaccgaaggcgaagccggcgggatcacccaagccattggggcctaccaagttaagtacaacgacaagttgatcaccttcttggacaccccagggcacgccgcctttaccgaaatgcgggcgcgtggggccaacatcaccgacatcaccgttctagtggtggccgccgatgacggggtgatgccacaaacgatcgaagccattaaccacgccaaggcagccggcacgccgatcatcgtcgtcgtgaacaagatcgacaagccgggcgctaacccggaccacgtcacggaacaactgaccgaatacggcctgatcccagaagactggggtggggacacgatttacgtcaaggtttccgccaagttcggcaagaacatcgacgaattgctcgacatgatcttgctgcaagccgaagtgatggaattaaaggcgaacccaggccaaaacgccgctggggcagtggtggaagcccgtctcgaccaggggaaggggtccgtagccaccctcttggttcaacaagggaccctgcacgtaggggacccaatcgtggtcggcgacacctttggtcgggtccggacgatgaccaacgaaaacggccggcggatcaaggacgccaccccatcgacgccagtcgaaattaccgggctcaacggggtgccggaagccggggaccactttgttgtctttgacgacgaaaagacggcccgggccgccggggaagaacgggctaagcgggccgaagatgaaaagcggcgccgcactagtcacgtgaccctggacaacctctttgacacgatgaagaagggtgaaatgaagtccctgccgatcatcatcaaggccgacgtgcaagggtccgttgaggccctcgcccaaagcctgcaaaagatccaggttgacggcgtgcgggtcgacatcatccacaaggccgttggggcgatctctgaatcagacgttaccctggccgaagcttccaacgccatcatcatcggctttaacgttcgcccaactccgctggcgaagtccgaagccgaaactaacaacatcgacatccgcttacaccgggtgatctacaacgcgatcgaagaagttgaagacgccatgaaggggatgctggaaccagtttacgaagaagaagtgctgggtcaagttgaagtgcggcaactttacaaggcgtccaagatcgggacgattgccggggggatggttgtctccggtaagatcacccgcgacgccaaggtccgcctgatccgtgacggcgtggtcatttacgaaggcgaattgggctcactcaagcgcttcaaggacgacgctaaggaagttaagatgggctttgaatgtgggttgacgatcaagaacttcaacgacgtcaaggaaaacgacgtcatcgaagcttaccacatgaaagaagttccggttaagtaaaggaggagcgccatgccgaataagcaattccgggtggaacggctcgcgcaacagattcagcgcgaagtcgacgacatcctcttaaagcgggtccgcgatccccgggtcaacggggtaacggtgaccggcgttgacgtaacgggtgacctgcagcaagcgacgatctactacacgatcctgtcgaagctggcttcggacgccgagaaaacccaaaccgggttggataaggcgaccgggctggtgcgcagcgagctggggagccgcctgaatattttcaaggcaccggaaattaagtttgtccgcgacccatcgattgaatacgggagtcgcattgacgagctgctgaacgagcttcacaaaaataacgagctctaacagtagttgggccctagcgttcgtttagtggacgttggggccttttttatagagcagaaaggaagaccaatggacggaatcattccactttataaggagcgggggatgacctcgtttgattgcatcgcccgattgcggcggattttacacaccaagaaggtcggccactcggggaccctggatcccaacgtggacggggtcttaccaattgcgatcggcaacgccaccaaggccgtggaatacctgatggcctcgggtaaggagtacgccggcgaattgacgattgggctagcgacgaccaccgaagacctcgatggggaagtggtcgaccaaaagccggtgccggcgcccatcgctcgagaaatgattgcggaaaaaatggccgaaatgaccggggaaatcacccaggtgccgccgatgtattcggccgtgaaggtcaaggggaagcgcttatacgagtacgctcgggctggtgaaaccgtggaacgccctaagcgccaagtgacgatcgaccagttcaccctgctagccaccagttacgaccaggaacggcaagtccagcgggtccgctttaaggtagcctgctccaaggggacgtatgtgcggaccctggccgtcgacctggccgccaagttgggctacccgggggtgatgtcgtctttgacccggttaaagtcgggtggcttcaccttggatcagaccctgagccttgatgacatccaagacatggtcacggcgagcgggatggtcaacttgtacccgcttgattacgccgtcaaggacctgccccacctggcactcaacgccgagcagtggcaagccgttcaaaacggtggctggctcaagcaaagcgaggtaaccccccaagagccgcgggtggtggttacctaccaaggggacaccaaggccgtttataagcacgttgagcgccactaccaacccgaaaagatgtttaagaatagttagagggaagacaatggaagtaataaaggtacaccatccactattagagcaacaggtaccggacggtccggtagtggtcgcaatgggcttttttgacggggttcaccgcggccaccaagcggtgatcgcccgggccaaagaagaggcggtccgccgccaggtccccctagccgttttgacctacgacaagctaccggggatcgtctaccagcgctacgatgagggggtccattacctgaccaccattgaccggaagctggccctgctggaacagctgggcgccgatctggtttacctggttgacttcacggccaaactcggcagcctgagtcccgaagagttcgtcagcgattacctagtcaggatgcacgcggtggcggtggtggccggttttgaccacacctatagcaaaaaggacgtcgccacgatggaccgcttggtggggtacgcggccggccgttttgacgtggtgacggttaaaaaacaggaaaccaggggcgcaaagattggctccagccggatccgcgacctgattgaccagggccgggtggaagacgctaaccagctcctgggctaccggtaccaaaccagcggaatcgtggttcacggtctggcccggggccggacgatcggctttccgaccgccaacgtcgcctgggacccgctcgaacggatcccggccgtgggtgtgtacacggtcaacttcttggttgacggccactggtacggcgggatggcctcggtgggctacaacgtcacctttgggcaaaataagcacaagacgatcgaagtttacctctttgatttcaagggtaacatttacggcgagcacgtcaccgtcagttggatacaacggctgcgcggcgaaattaagtttgacggcgttgatggtttaattgaccagctccacgccgaccaaatcaactcgctagcgatcttaaggaaccccccgaccttaccggcggggccgttaaattagtcagcgttataaagattaaagaggccggggaaggtgggctccccggcctttttttgttcccggctaagtggtatatttaagaaattatcgttacttaggagcgggagaagaaaattgaaggatcaacgaattgcacggtcactagtcattatggtctttgggaccttctttgggttattgtgttccaccctgatgaatacggggttgccccagttaatgcgggtctttagcgtgagtgaggggacggtgcagtggatcatcaacgcctacatgctaacgaacgccatgatgatcccgttatcggcctacctgattcggcgctggtcctttcgcaccctctttatcatcgccacggcggtctttttagttggcacggtggggggagcggtggcgcccaccttttggacggtcgtgattgcccgggtggttcaagcggctggggcggggatcatgatgcccctggtcaacgtcttggcgatccgctacgccgaacccaagaaaaaggggacgatcatggggatcattggactggcctttaacttctcgccgatcattggtccgaccgtgtcggggctaatcctagacgacctatcctggcgctggctctttttggtaatcgtgcccttctccgtactcaccttagtggcggcggtgatccagttgccccggatcccccacaacgaaaacccccacttcgacacccgcgggatggcgattgtctcaatcggcctgtgggcattactgatggggctatccaacgtttcgaccagcccgttttggacctggcaggtgctggggctcttagttgtcggggcggtcgcgttagtcatcttttacttcagccaacgcggggttaaggcgcccttgattaacttctcggtgatggcctatgatcaattcgtggtggcaaccttgatcaacatgttgatcgtggcgaccatgtttggcaacaccatcttattgccgctcctagtgcaaaacgttcaacaaaaaagcgccctggtgtcaggactagtgatcctgccgggggcgctagtgacggggttcttgtcgcggttaagcgggcggttgtacgaccgcttgtcggtgcggcggctggtcttgttcggactggtggtggacggagcggggaccctgtttcaagctacgattggcgccgctagtgggccggtggtcttagcgctctttcaggcggtgcgccagctggggttggtttcgatgctgatccccctgcaaacccacgccctggggatcttaccctttgacctggtgccagacggggtagcgacttttaacaccatccgtcaggtagcggcctcgctgggaacggcggtgctcgtttctgtcgtcggcttaatggggcagtggggccaccgggggaccctctttgggatccaggccggttttgccacctgctttatcttcttggtggccgccatgatgatcgccgggcggctcaaaaaccagtttaaactgggccggccgacggtgagtgccgggtaaaggaggatggcaaatgacttcccgggcaggtcgtatttaggcactaggtctgccgtacaatagccttaaaagttgtcactttaagaaataaaaagtgatgacttttgaggctatttttatgaaaatcacctattcaacgactactaagcttcgcttattaagtcaattttaaaacgttaacgagtcactcaaggttttcgctgattatcacaatgtaggtgcagggagtttaaagcgttggatccagcagtatctaactggcggattggctaatttagagcgcccagtacacaatcgccggtaccctaagaagcttaagcttcgtgccgtcggtgattatcgaaatcaccatcttcctaccaaagaaatcctattaaagtatgatatccgtggattatcccaacttcgtaactgggtcatcctttacaataatggtaaagaaccagtaagaaagcgggtgcggaagatgggacgaaaggtctcgtatgacgagaaaatcgaaatcgttaaatgggtcttgaagcataatcatgactacaagcaagtagcgcaaaagtttgatattacctattccagagcgtatgcctggacacagaaatacgagcaagcaaacgattggacggccctaaaggaccagcgtggcaagaccaggggtaggcaaccagccgaccgtgagaaacagttactcaaagagattcgggacctcaaagctaaattacgtgaaagagaggttcagattgccttctcaaaaaaattgatcgaaataagcaaccgggaggtgaagcggccaaacgatatcaagcggttcaagaaatgactagcagtggcgagtacacagttagtgaaacggcccgagctgcggaaatcagtcggcaagcgtattacaaatggttaaatcgtagattatcgctacgcgaacagcaggaacgggaagtactggaggagatcaagcgaatcgaaaaacggcatcaagatagtgttggatacgataagatggttcgtctattgaataaagagggccaattaagttacagagtggggattaagcgggttagcaggattatgaaaattaatggaattcgggcggattaccggcagccaaaaaaggaccgccagggagcaaaacaaacctatcaagatgaaaacctactaaatcggcgatttaagcaagaaaagccgaatcaggtttgggtaacagatacaatagaactgacttacgggaccgctaataaagtccgtctacacgcctctatatggacaaaggccagtagcatggttaatctcaccaacggagaccagtgaagccgcaatcaaagtctttaaccaagccgctaaggctagtggaaccactccagaaatgatccatacggatcgtggagcggcatatacgtccaccaattacaacgaagctctccgtcaggagaaggtaaggcatagccgatcggcgcctgggacaccagcggataacgccgtaatggaacactggtgggcagattttaaaagcatctggctcgagcatcgtccaaaggcgcaaactctagcagagttacaggaacaggttcgtgctggaataatgtacttcacaaatcagttcatttccgctaaaagaaatgaccaaaccgtggcggaatattaccacgatttggtcggataagaaaaattgtgttttcgtttttataagtgtcaacttgacaggggatagtaccgatttttcaagcaacttaaaaatctcctttttcggttttctgtaatttaaagagcataaggggaaatctaccaccgactagtctgtggcccgccagtgacgtggataccaattttctcggttcgcacctataatgcaccctcagcgagtacgttttgctgcccaaaatgactccgcaatgcgtccatcagcgatttacgaattctgcacgacacaatggcttctgaaatggctgacaaataaaatccctgcctcgattttgagacagggatttcattttttaagatttttaggatagatatgagtaaacgataaactacttcaattaagcattgggctgttcttgaattcggctgacaaacagtgcgccgctgacaaaaacaataccggccaaaaggagcatccccggcatggacttgccaatcaatgggaagatggcaaagctggcaacggaagcaatgatttgcggcaggcagatgctgcagttgaacaatcccagatatgccccttcatgcttaccggccagcgcagtcgtcagcagggcaaacggaatcgagttcattgaaatccagccaatgccgatcagagcgaaagaaagaatcaaaagcatcttatcgtgaatgaagaacactgacataaagccaagtccgccaagaaccagacctaaacgatacatcgtcttgcgctggtttggcttggtctttgacagaaccattccccacagtacggctgaaatcgactgaaccgcggataaaacaccgaaccagttgccggcagcctgatagccagccgttgacggatcagttacattccagacattctttgcaacagcaccagtaccgtaagtccaaaggtattggaacgcaaaccaacagaacatctgaacgagagagatctgccaaaatgccttaggtgcgttcttcagcaaagttgcgaaactaagcttttcttgattggctgcaatatcaacgccatggtacttggcatagtcttgagggttgtattcatgaactttggccagcgtgaagatactggttaagagcagtacagctgcgcccaggtagaaggtccagatgactgagttaggcaaggagcccttcttagcagtattggaaacccctaaaagcgtcatgatgaatggcattaaggttgctagaattccacccatgttagagaagatttgttgccaggaccaagcaaagtctttctgatcctcgttaaccatatcaccaataatcatcttgaatggctgcatgcagacgtttgaagacagatccatgaacagaaccgcaattgcaccaaaccaaagcgcggctaatgaaccatacccgaaaccaaatgatcccgcgttgggcagaaggatcagaaccaaagccgcaattggtgcgccgaccaaaagataaggcatccgacgaccaaatcgattccatgttaagtcagaatacttgccgactaatggttgaacgatcattcccatcagtggcggcaaaatgaagaagaagccaagcttggtcggatcagcaccgattgtttgaaagattcttcccatttgcgagctttgcagcgaaaatgccatgttaacgccgaagaacccaaaagtcatggcaaacagggtacttattggcagactcggcagtcccgtagttgttttttgattttccatattacttgttacctctttgaactgaattcatatactttagcttcatatggacgcagagtttctcccatgtcatcctcgtagttgcttaataagagcttgccttgaccagccgcgtattctcgcttgattgtttccttagtaaagttggctactacaagcagcgttgtttctccatcatcacgcgtgtaagcaaagacctgctcatccaattcgttgccattgaccaacgcaaactttccttctgtcattactggcaagtcatggcgcatttgaatgagtttctggtagtgatagaagacggatgatggatccgccagtgccgcctttgcgttgatctctgaatagttgggattgaccgcgatccaaggttcagcatccgaaaatccggcattcttgctgtcatcccattgcattggcgttctggcattgtcccgagaatgaattgccagatatctgctcattgtctttccatcaactagatgctcttcgtcaaccagctgatggtaggcattaatgctctccaaatcacgatagtcagacaaagagttaaaggtcgtgttggtcattcccagttcctcacctgcgtagatataaggcgtgccttgcagacagtgcagcattgttgccaacattttagccgaaacgacacgatattttggatcatcattgccaaaacgggatacgacgcgtggctgatcatggttgttccagtaaagcgagttccaagccttaccattcagctgagtctgccatttcaccaggttatctcgcaattctggcagactgacttttttgtcgctccattttcctaaagctgggttgtcgttaccgtctaagccgacatgctcaaactcaaaaaccatgttcagctcagtctgttcaaggttggcgtacttcttggcatcatctgttgtagcaccaggtgtttcgccaactgttaccaaatcatgcttggccattacagcttgatgcatttcttgaaggaattcgtgcatccgatgaccattggcaacaaccggctcgacatcgccatactgcattccgggcgcggttggaacgtctttgtagacagccggttttgaaattaagttgatgacatccattcgaaatccatcgacaccgagatctgcccaccaattcatgatgtcgtataccgaatgacgaacggcttcattttcccagtttagatccggctgctttacagcgaacaggtgaaggtagtattgaccgcttgtctcatcgtactgccaagctgaaccagagaagtatgatccccaattagttggttcatggccatcgactggatcacgccagatataatagtcacggtatggattttcttttccttggcggctttgcttaaaccattcattttcatctgatgagtgattgaccaccagatccatcattatttttaatccaagttcatgagcctttgtcagcagctccttaaagtcggtcaatgagccaaaagttggatcaattgcccgataatcactgatgtcatacccattatcaacgtttggcgaacggtagattggattgagccagataatatcagcacctagttttttaatatagtcaagccgactgatgattccttttaaatcaccaatgccatcatgattgctgtcttgaaaactccgtggatagacttggtagacaactgaattttgccaccaccattttggtgtatatatcattattatcattccttgtaaaaaaattaaaaataaaagttacgcaaacgtttgagtaaatgctaaaataataaaaacggcataagtaaccgttttcacggagtattataaatacagctaacttaaaaagtcaataactttttttgaaagaaggatcccgatggccacgattaaagacatagccagactagcaaaagtaactccatcaaccgtctctcgcgtattaaaccatagtgggggatacagcgaaaaaactcgccgtcgggttgagaaaattgcagatgagctacactatcaaaaaaacgaagctgccgttaatctggttgcacagacctcaaatctgattggagtaatcgtaaccaatgccacaacgagctttgccgcccccattatcgacagcattgaagattgggcctaccaaaatggcggaagaattctcttggctcactgtggcttaaatgactctgaacgactgaagacatgcctaaatctaatggctgggcgcaaagtcaacggtatcatttcagtttcggttcaatttgatgagaacaatctgaaactacttgatcaactgcagctgccattaatttctctaggcgtcaaagtttccaaccaaccaatgatttccatcgacaacctaaaagccgccactacagggaccaattatctaatcagccgcggataccaacggattgctctgattgccgtagataccagcgacccgcaaactggtagaacgcgttgcgcaggatatcaaaaagcaatggagtcagctggacttacaccatctattattcccggtgactactcgtttgcagcaggaaagcaggccgcagaatttcttttagcaaaaggagaacttcccgaggcaatttttgcagccagtgacgatgccgcagccggggttatctatgccgctcaggaacacggcattaaagtacctgagcaattggcagttctgggttttgacaactcatcagtagccagtatgatctatccgggaatcacaacgattgatcagccattcaagcagatgggacggttggcaattgaacacttgaccaaccagaatgtttcttcagttgagttgccatatcaaataaaggaacgtggctctgttgccaaatacaattcagctcagtcatagtgcagttctggcaatcaaaaacaggctcgtggaatctccacgggcctgcttgccgtattgttactctcaaaccctttatcatcatttccatctttacgaacactcattcgcacattgtaatagaatgcaaacagaagttcgaggagggcagcaagatggactgttcagaagagccgcggggaattttcctggtcattgataacaaatcattctatgccacggttgagtgcacgatgcgcgggctggatccgctcaccacgccgctcgtagtcatgtcagaagccgaaaataccaatggcgggctggtgctggcatcatctccaatggccaaaaagctttacggcatctccaacgtcaatcgtcagcgtgatctgccgcacgacaaccatttgattgtggtgccgccacggatgaatacgtacatcgaaaagaacattgaggtcaacaacatctatcgcgagttcgtggccgatgaggacctgctgccgtattcgattgacgagtcgattctggacatcactcattcctggaaactgttcggggatgatccaattgcggtcgttaaaaagatccaaaagactgttcatgaccgcctgaagctggttaccacggtaggcgtgggcgaaaatccgctgcaggccaagattgcgttggacgtctatgccaagcatgatccacgcttcattggcgagattacctatgacacggtcaaaaaaaagatctggtccatccctaagatcactgatgcctggggcatcaacgagcgaaccgccaaacgtcttgccggactggggattcattctatggctgagctggctcatgccgacccgttcattctcaaggaaaagatgggcgttatcggcgcgcagctgtacgcctctgcctggagaatcgatcgcaccgacctcgctgaggaagtcctgccaaaagacaagagcctgggcaattcgcaggtcctaccgcacgattatacgagagccgaggagattgaagtcgtcattcgagaaatcggttcacaggtagcttctcggctccgcgcgcacgacaagcaggcagggggcgtgtacctttcaatcggctattctcaatcggctattcgctgagcacgccaacggaagaaaccggctttgcccactcgctgaagctttccgattcaacggtctattcaaacctcatcaatgggcagctgctttatctgttctatacatactgggatggagtatcgccggttcgccgcatcagcgtggccgcgactcgcttggctgaccgctatggcgagcagctcgatctgttcaatccgcccaaatacgacatggttaagctggaagacaccgttgacgccatccgcaaacgctttggcaagacgtcaatcatgcgggcgtccagcttggagaagggtggcacgtttatcgaaagaagccagttggtaggaggtcatgccggtggacaaagcttggaataaagaaaccgaaagcgaaaaaatctgtgagcgaatcaagcgctgcttcaccaatcgctggcgcaccagatactgggtctccgtggtctactatgagccggagcatggctataatctgtttctcaacattcagccgcgcaacgcctacagccggtccatccccattgctcgactggctgattgtgattattctgagttgcttgatattataactgatgttcgtcaaacgtatcatttcacgctcaactacctaaactttcctgatgaccaggtccgtaaaatgaggaggaactttcgatgagaatgcagttttacgatgatcaagaggctgacaaggtggccacgcagttttttaaatggtagattgcaagaaataaccgtttttccttgaatttgttgaaaaaccatgtgattatggaagcgtattcaaatgccgtgaggaggctactatttatgaatagacaatttgatttcttaatgccaagtgttaacttctttggtcctggtgttatcgccaagattggtgaccgtgctaagatgcttaacatgcacaagccactggtcgttacccaagagagcttggaaaagatcgaaaacggccccgttgttcaaacgattgaatcactgaagaaggctggcgtggactacgccatcttcaccggtgttgaacctaacccaaagattcgtaacatcaaggctggtaagaagatgtacgaagaagagaagtgtgactccatcatcactgttggtgggggctctgctcacgactgtggtaagggaatcggtattgtcctgactaacggtgatgacatcactaagttggccggaattgaaacgctggacaacccactgccacctctgatggctgttaacaccaccgccgggactggttcagaattgacccggcacgcggttatcacgaacgaagaagaccacctgaagttcgttgttgtttcctggcgtaacattccgttggtatccttcaacgacccaatgctgatgctcggtgtgccaaagtcagttactgctgctaccggttgtgacgcctttgttcaagcaatcgaaccatacgtttctgttgaccacaacccaatcacggacagtcaatgtaaggaagctatccaactgatccaagaagcattgccagaagctgttgccaatggtcaaaatgttgaagcacggaccaagatggttgaagctgaaatgctggccgggatggccttcaacaacgccaacctgggttacgttcatgccatggctcaccaactcggtggtcaatacgatgctccacacggtgtttgctgtgcattgctgctgaccacggttgaagagtacaacctgattgcttgcccagatcggttcgccgaactggcccggattatgggttacgacaccaccggcctgaccaccatgcaagctgccgagaagtcaatcgacgggatgcgtgaaatgtgcaaggcagttggtattccatcatccatcaaggcaatcggtgctaagccagaagacttttcattgatggctgaaaatgccctgaaggatgggaacgcattctccaacccacgtaagggtacgaagcaagacatcattgacctttaccaaaaggcatacgatggtatttactaattaacggtgtgggcacatttaattagcaacgaaaaagtcacccgcaggtgaaaacctcatctgcggatgacttttttagtatttggtagattgtaaaatttgagttgaacatattagacagaaaaacccataaaggtctttaatggtgtcaccacaacattccattagaaagaaggacctttatgggcaccactattttatcatttgaagaccgcgttgtcatcgaaacacttcatcatgaaaagcactcacttcaatatattgccgattatttaggctttagtaaaaccactatctttaatgaggtttatcgcttagctggtgagtatcacgcagttaaggctcaaactgaccatgaagttaaacttagtcatcgtggtcgtaaaaccatcttaacgactaacctaaagcgattgattgaagaaaaaatcaagatccaaaaatggtcaattgaacaagtggctcatgtagttagaattacctacaaaatcatctataactggattgatcagggactactggatattaatgtgactgatttacctaaccatggtattcgtcggtattcgtcgcaaacgagctaaagaaacccgtggtagttttagtcatggacgttccatcgaagatcgtccagctgaaatttctgatcgtaatacttcaggtcacttcgaagctgatacagttttatctggaaaacgtaaaggtcaagcagtagctacgtttgtcgagcgtaagagtcggcttaccatcgttaaacggcttaatggacgagatagtacttcaatgaccaaggctattttagaattggctaaccagttaggagataatctcaaggcccttactgttgaccatgggaaagaattcgccaactacaatttgattgaagaacagaccggtgttccgctgtactttgcgcacgcttattcgccacatgaacgaggcagtaatgaaaatcgcaaccgagtactacgccgcttcattcccaaaggtcaaccgattgatgagattaccgatgatgaattgattcaaattaactggtatttgaattgccgaccactcaaatgtttaaattggcgaacaccgattgagatctttttgcgtaatctgcgttactaaatttgttcaagttatttcttgcaatctgccattagctaaaagtatttggctaacttgattataaaacgcgcgagtttaacgactttttggccatctgtccagaaatcgtgtcactttatctaacaggtgtcattgatcacaactcacatgaaacgtggcaaacgtcatcctggcacgggaatggtgaacttaaatcacattgaactttttgggtgcggcgcaaacttttttaacgaataaggttgactttaataattctcccagttattctgtgtgcatggttagaaaatgatgagattaattaaagaaaccaaggatgagctttagggaacggcttagcaagcgtggctgctgaaaacacgtgcgatcccttttgtaaaagttagtttcgagcatactgggcggtcgccactagtcgactattgagcaataaacgaaggtggtaccgcgcaaacgtgccctttagcaggaatgatttggagcgcgtttttctcattatttccaaagacagccaataaacgaagggaagtacatatgatgacaaaatatacagtaatcggcgcaggcgccatgggccttcgctatggggtcttgattcaagaacgcactggcaacccagtcgacttcatcgacacttgggaacccagcgtcaacacaatacaggaacaaaaaggcacttgggtatcgcgtgaccacaaagacaagcacatggtcccaatcaatatttccttcccagaagactacaccggcgatcctgacgtgtggatcattttcgtcaagcaaatgcaattggccgaggtcttgaagcgctgcgccccattgtttaaagcgcatcaatatgccttctctgcgatgaacgggatgggccacatcgataaaatctctgaatacttcccagatgaccatatcgtcggcggcaccgccatgatcgccacagttttgaatggccctggcgatgtcgacttcatgggcgccccgcgcaccggcgtgatgcatatgtgcaacaagaccgaaaaaactgacgccatgacccaacaaatgtttgatgatttcaaagcagccggcttaggtccgattttaaccgagaacttcatggggactttgatgtctaaagtcgtcttcaacgccgtggtcaacaccttgtgcacgatgtttgaaatcaccatgggccagttcatcgagtaccctggcgccaaggacatggccgaacaattgatgaatgaatcgtttgatgcttgcgaacgcgcgggcatccacttggttgaaacccgccaagaagaagttgaatctgtcgattatgtttcgcgcgttgccaacccttaccattatccttccatgtatcaagatttctccaaaggccgcaacacggaagtcgactatatcaacggctatatcgctaaaatcggccgcgagcacgactacatctgccgcacccatgaattcttggttcatgaagttcatatggcggaaatgatgcgcaaatacaagcaagccaaatagctttgaatttcgaatccttctataatatcccgcaacgccttaccagctttgcgggttttttactggcttgagaatgcaaataggcgaccccataaaaatggcacctcattgatgagacacatgaattattcgtttaagtttgctgatagggggaactaggtcttttaagtcatcccatccagctccgtccttaatccggcggatgatttcttttgtatccatgtcagagctatgataccaagtcccatcgggcaacataagcatgtccaggtcttggttatattttattttgccaaaccgaaaaggagccgggaaaagtactgcttccccagcttcttattaatcttacaatgtcagcaaaaaggcaattaaagccggtaacagctgtattacccaaatcttctttgtcgcagtaaagccaccgtaaagggccaccaccatgataaagactagtagcatttgccacaccgtaatcaacagtacaccgcggacaagccaataactggcaatgatcattacccccagcgcaccattataaattccctggttagcaaacgatatccgcgcttccttttgccgcgtgaattcaactggtaggtcaaatgcccgtgcctgttgctctggactggcaaacatttcaatcagcataattccgatgtgcccgatggccaccagcattaccacaaaaattactaacatttctattctcccttatttaacgtactggtttaggaaacgcgccacatgctgtggatactcgtgtggctctttctcataagaggcggcatgcttagcaccctttaccacccataacttctttggtcccttcgtcgcggcgtagttctggtaaaccatcttagtcggcacaaaggtatccttgctgccatggatgaaaagcatcggccggtggttgcgggccaacattgccgttgagctagcctcatgagtgtaaaagccattttttacccggttaattaaactcaacgagccaattaacggtgcgcgtattacccggggaatattatacaggtttcccgcctcatagttaagctcggcattaagactgtcgtaaccgaaatcctcaacaaaggccttgacctggcgaggaaggtggattccactagtcatcatcgttgtggcaccacccatactgactccgaagataacgatttgactgtcctgaccattatgagcgattaacttcttactccacttccgtacgtcgtagcgctctggccagccatagccaatatactttccctgactttggccatgtgctctggcgtctggcagcaggacgttataaccctgctggtggaacattgctgcatactcccccgtccttaatttaataaccggctcaaaattgagcccgtagattattagttctgttttttatatctgacaaagagcccaataactacgtacataaaaaagaaagagaccggaaagtgtgtcttccagtctcttttatcattttgctattaagcgacgtgtctaccgggcgaggatctgttgcggttcgtccagtaattcccggcctttatcataatatttctgcatttcatcatcggggaccagttttccaccggtggcccaaacaacgtgggtggcgttcttcaacgctgccttgtttttaaactcgtttacggttggtacaatagcggtgaagcctgcagctgcggatggttcaacgtaaataccttgggtatccgccaacatggcaaggtagcggtagatgtcatcatcgctgaaggtgtgcgcaccgtataacagggtccgcattacacggccggcaatctttgatgagcggggaacagctaacccgtctgcgagggtcttgccgtcgatgcccagatccgtcacggcgatcttgtcgtacaggtgggtcatcatgcccatggtaacggatggcacgtgagtcggttcggcgaaaacaggatagataccctctggcatcattatttgcaagccaaagctaacgccgcttggactaccgccgacaccggctggcaggtagacgaaaacggggtggtcggcgtctgggaagatgccgtcatcagcgaattgtttttgaatttcgatcccaactgctgaataaccgaggaacaggtcctttgagccttcgtcatcaatgaagtaggtgtgcggatccttagccgcttcttcccggccttgggcgatggcaactgagacgctgtcgttatgttcaacaacggtcacgccgtttgctcgcagcatgtccttcttccactgacgcgcgtcaacggacatgtgtacagtggtcttaaaaccaaagctggctgcggccataccgatgcttaaccctaagttaccggttgagccgaccatgataccgtaatcggcaaacagtttgtggtattcaggggtggccaagattgcataatcatcagagtaggtgaggttggtttcagtggttgcaacgtgttcagcaaacttcagaacttcgtagatgccgccccgtgacttgatggaaccggagatggggagcatactgtcagccttcaggtagacgttgccaggaatctcagcatcgtttaaactggccaaacgagactgcatcttatcgatcttgatcagcggcgagatcaactgaccgttggttttctgggtttcaggaaacacggtggccagatagggtgcaaaccgtttgaaacgggccgcaacgtcaaagacttcggcttgcgtaaacggaatttcagccttttcaccaaattctgggttgatccagtcgatcgcctcgtactgacgcatattgtttaatagtgggaatttatggagtaattgttcaatgttttctgtcatattaatagtgcctccaaggtgctggagagtataaaatagtttgtgtaaatgaataaaagtcttgttgaaaagggaattccttccccgtatgattaaatcatccaaatcaaaccaaaacggagggattcaccatggatcagtttaccaaaaatctaaccaaaaactctattgtcaaatgacgatgttaaagacctttttcgtcaacaactcgaaacgactattaatcacatcttgcaagctgaactaactgccttacttggttatgatccttatgaccgcagtggctttattatttatactgatcgatgtttgctaatgccgtttttttctgacgaaaatattctatactaccgaatactaaagtccaaacaattgctccaatagcaccaataatatcttcagggataaagaatagacttacaaagataaccccaaagaagaatatagttaatgggctagttactttataccatggcataacaaatccatttggcaagaaatcacttgaggcacgatactttctatgtgcaatcatagttaatgtataaacaattatatacatatcactagaaactccagtcactatagtgaatacagaactaattgcagtggttaaactcatcaacggtgtgattaaaacaagtgcagctgataaaataattgctgctgcaggcacaccatttttggaaatcttggcaaaagtcttattcatccagctacttttcggaacttcagttgccaattggtaaaaatgccgacccgctgaaaaaatacaactattcaatgctgatgctgcagatgttaacaccacaaagttaatagtagcagctgcagcgggaaaacctgcaagcttgaatacttggacaaaggggctactgttagcagacaaggatgtccacggaataatccccataattacaattaaagccccaatgtaaaataacaaaattcgaagaagcgtctcattaaccgcttttttaatgactgcatgtggtgatttagcctcaccaattgtaatactaacaaattcaataccttgaaaagcaaagaaaaccatgggaaatgcagatacaaaattaaaaataccgtgtgggaatagtgtgtaatcatgaaaaatgtttgacaacgatgcatgaccaagtggtgtaattgaatgacttgtcatcataaaaattccagttacaatcatagcaataatagcgatgattttaatcatagcaaaccaaaattcagcttcaccaaaaagtctcgcggcgatcaagttaacacttgttaatactgctaagaatactagctcaacaagccaagaaggaatcgttggaaaccaatattgcacataactagctgtagcagttaattcagccatacaaacgaacaccaagccaatccagtaagtccacccagtaaaatggcctacagttggacccaaataccgtgaaataaatgaaacaaaagtatgctgtgagggatccgaataaaacatttccccaattgctcgcatcataaagaaaaagaacaaagctagcgttagataaactaacattattgaaggccctgttttgctaattgtacttcctgaacctaagaatagcccggtcccaatcgtacctccaattgcaatcatctggacatggcgattgcttaaagcccgcatcgtcccatcttggttttctacaacttttgatttcatatgttagcctccaagaataaatgagaataaatgataataaaatgagctttttttaattttattatcatttattctatcatgttttgtgactagatgtctgggcctagaataaaaggtgtacaagttaagtagagactctgatttagtataattaatgaagtaaattggaggatctgggcctagaataaaaagtgtacaagttaaatagagactctgatttagtataattaaggaagtaaattggaggatcaaataatgacgaagcacagttatgacaaggaatttaaggaacaggccgctcagtattacttaggtaacaaggatcacatgaccatggatgaaataagtaagaatctaggtattggggctagtacattacataaatggattaagctgtttactgagactggggagtttggccgtggctctggtaattttgccagcgataaggacaaggagattgcacgactaaagcgtcaacttcgtgacgctgaaggagcgatcgaagtattaaaaaaatcaatcgggattctgagcaagtaactaccgaaaaggtataccaagaaatggacgttcagcacgctttggaatcccacccttccatcaatggtatgtgtgattatgttggaatctcaagaagtggttactatcaacgagaaaagcgtcataatcaccaatcaccgcgaaagcttcggaagaagtttattcaaggtgaaattaaagcaatttggctcaaaagcctttgtatttacggtgccggcaaaatcacccaagaacttcgctcaaaaggatataagatcgctgaacgaactgttgttaagtatatgcgtgaacttggcattcacgccgtttacctaaccccttggactactaccactcgcaattctaagtttgataaacagctaataaatattttagacgagcagttcaatccattgcgaccaaacgccgtttggtgcattgacaccacttatattccagttcatgacggattcgtttatttaaccagtattatggacttgtactcccgacggatcattggttgggacttatctgaaaccttggaggtatcgaatgtcatcccacttattgaaaagactaagcacagtcgccatattagcaagccattaatcatgcacagtgatcgtggtagtcagtttacgtctgaagcttacaatcaagttacagctaacatgacattaagctattcaaagaaagcttatccttggaataatgcctgcattgagtcgtttcatgccttgattaagcgtgaatggataaatcggtttaaaatccattcatactccgaagctaaacgactagtttttcagtacattgaaacgttttacaacacagttagaattcacagtcactgtggattcaaatcaccaaagcaacttgaagatgagtatcaaactcaaattcaaaatttagtcgtggcataggacaaaaaagtctctatttaaattgtctattttattgacaggggaccaccgctaatccacactgatcgcggagcagcatatacttccaaagcattcaaccactacttggctagtaataacagccaacatagttactcagccccaggaacgccagctgataatgcggtgatggagcactggtgggctgattttaaatctatctggttagcatactcaccacaaccacaaacgtttgaagacttagaacagctggtgacagaaggtatcgattactttacgcattcctttatttcaggcaaaagaaatgaccttactgcagcagaataccgcttcggcaaggccaactagtttttattatttaatgtgtcaacttgacagggtacagtaccattttagaattggctaaccagttaggagataatctcaaggcccttactgttgaccatgggaaagaattcgccaactacaatttgattgaagaacagaccggtgttccgctgtactttgcgcacgcttattcgccacatgaacgaggcagtaatgaaaatcgcaaccgagtactacgccgcttcattcccaaaggtcaaccgattgatgagattaccgatgatgaattgattcaaattaactggtatttgaattgccgaccactcaaatgtttaaattggcgaacaccgattgagatctttttgcgtaatctgcgttactaaatttgttcaagttatttcttgcaatctaccaaaaggtaattatttttaacaaagtggtcccatgttgcccccactaaaaagcccctcaccacgcactcggcgcggggaggggcggtgataattgatttaattagtggcggctagcgcggtggttgctggtcccgtttatcttgtggatccggcgcttgtatttaggttggttgccatcttctagtttaaagtggcgcatcttgcccaagaaggggcgcccactgagccggatccgggtccacgcttgcattagctcgatcatgccggtcagctgttcgacgcgcttgggcccctcggtggtagcggcggccatgatatcgtcgtttaaacgggtaaccaggttattatggtagttcaatagctcgctagttagcggggcgttgcggtatgaattaaaaagcttttggatcaactccatggcttccttggcgctttggggctggatataacggtgatctgctggcatgatgttcctcggtgataaattgtgaaaagatctttgacttttgttgacttttaacgggacggttggtatattatacattgtatttagcacttagatggccagagtgctaaaaggaagtgatcaagatgctaaccaaacgtcaaaaagaagtcctgcaagcgattgtacgccaatacaccacgaccggtcaaccggtcggctccaaggcacttgtcgatcacctggccaaaaaggtctcttcggccaccattcgaaacgaaatggcggtgttagagcacgaagggctggtgacaaaggagcactccagttccgggcgggtaccgtccaagctggggtaccgttattacgtcgaccacttactggatccgttgtcggtaactaaaaatgacctgattgtaattcaaaactcgttgggtaccgagtaccaaaagattgatgagatcgtttcgcactcggccgacctcttgtcgaacctgacgagttacaccgcctttaccttaaagccggagcaaaaggacgcccgcctaagtggttttcgcctggttccgctgggcaaccaaaaggtgattgccatcttggtaacggacaccggggacgtggagagtcaatccttcaccctgccccgggggatcgacaccgaggccatggaagcagtcatccgattgatcaacgaccagctaaccgggctaaccttaccggaggtggttaagcgcctcgtcacggacatcccgttgcaggtgacccgccacctccaccaacccgagggcttcttgaacatctttgattcggtggcttcccgggccgctcacgagcgcttctttgtggggggacggttgaatttgctaggctttgccaaccagcaaaacccggcggcggtccaagaattatacgcgctcttggaccacggcaacaatttgcaggccattttggatccggatgacgaacacgatatctcggttcggattggaaatgagattgccgacaaccaggtcttagatgactacagtttgatcacagcaaagtatcaagttgaccagtatggggaaggtatcatcgccgtcttaggcccgacccggatgccctacgccaggaccattgggttggtggataccttccgccgcgagctggccaagcgcttacttgatcactaccgccgctattacgactcctaggagggattaaatggcaaaagatgaggaaaagaactcccaagcttccgcagccccaaacgagggggaagtaaaggctaagcaggaacagacgtcggccaaggaaccggcggctaaggccggggagaccgaaaaagttgccgatttgcaaaagcaagttgaagaattaaccaagcaactggatgaccaaaaggaccagaacctgcgggcccaagccgaaatgcaaaacatgaccaagcgctttaaaaaggaacaggcgcaactgctcaagtacgatggtcaggacctggccaagggcattttgccggttttggacaacttaaagcgggccctggaaattgaagttgaagacgaaaacggtcaacaactcaagaaggggatccaaatggtgcacgaccacctggaaaaggccttagccgaccacgacatcaaagaagttgaggcgttaaaccaaccctttgatccgaccacgcaacaagcggtgcaaaccgtcgctgctagtggtgatcaaaagccggacaccgttgtgcaggtgctccaggccggttacgtcttgcatgaccgggtcctgcgcccagccatggtgatcgtggcccagtaacaaactgaaaattaataattaaaagagggatttaagtatggcaagtaacaagattattggtatcgatctcggtactactaactccgccgttgccgtgatggaaggtaacgaaccaaagattatcaccaacccagaagggggccggaccacgccgtccgttgtttcctttaagaacggtgaagttcaagttggggaagtggccaagcgccaagcaatcaccaacccgaacacggtcaagtcgatcaagagccacatgggtgaagccggctacaccgttgacatcgaaggcaagaagtacacgccgcaagaaatttcggccatgattttacaatacatcaagaagtacgccgaagactacatcggtgacacggtgaccgaagccgtgatcacggtgccggcttacttcaacgacgcccaacgtcaagctaccaaggacgccgggaagatcgccggtttagacgttaagcggatcatcaacgaaccaaccgcttcttcgttggcttacgggctggacaagaaggacagggacgaaaagatcctggtttacgaccttggtggtgggaccttcgacgtttcgatcctcgaactcggggatggggtcttccaagtgctctctactaacggggacacccacctcgggggggacgacttcgaccaaaagatcatggactggctgattgacggtttcaagcaagaaaacggcatcgacctgtcccaagacaagatggcccttcaacggctcaaggacgccgctgaaaaggccaagaaggacgtttccggggttcaagaagcccaaatctccctgccgttcatcacgtccggcgacaacggtccgctccacttggaaaagaccttaacccgggcccaattcaaccaattgactaacgacctggttgaacggactaagcaaccggttctaaacgccttaaaggacgccgaactcagcttctcagacattgacgaagtgatcttaaacggtggttccacccggatcccggccgttcaagaaatggtgaagtccttgaccggtaaggaaccaaaccactcaatcaacccggacgaagccgttgccctcggggccgccatccaaggtggggtcttaaccggtgacgttaaggacgtcgttctcctcgacgtgacgccgctgtccctcgggattgaaacgatggggggcgtcttcactaagctgatcgaccgcaacaccaccatcccaacttccaagagccaagtcttctccacggccgcggacaaccaaccagccgttgacattcacgtcctccagggtgaacgcccaatggccgccgacaacaagacgctcgggaacttccaactgacggacattccgcctgcaccacgtggtgttccgcaaatcaaggtaacctttgacatcgacaagaacgggatcgtcaacgtttctgccgaagaccaagggacccacaagaagcaaaacatcaccatcaagtccaactctggtttgtccgacgaagaaatcgaacggatgaaaaaggacgccgaagccaacgccgaagccgacaagaagaagaaggaagaagccgacttacgtaacgaaaccgaccaactcctcttccaaaccgacaagaccttagaagaacttaaggggaaggtttccgacgacgaaatcaagaaggcccaagacgccaaggacgccctgcaaaaggcgaaggacgacaacaacttagaggacatgaaggccaaaaaggatgacttaaacaagatcgttcaggacctgaccgttaagttgtaccaacaagcccaacaagaaaaccaagctaacggtggccaaccaactggcgaccaaggtgacggcaagaaggacgacgacaacaccgttgacggggactttgaagaagttaaccccgacgacaagaagtaattaggtcctataattgagcaagaagccaaaggccaggaaaccggactttggcttttgcttgctatggtgaactgtgcgataataacctacaaaatttagtgagaggtattcatggcagaagaagatttatacgacgttctcggtgtcaaaaaggacgcctcggaggccgaaattaagcgggcctaccggaagttggcggccaagtaccacccggacgtaaaccacgagccgggcgccgaaaaaaagtttaaaaagataaacgaggcctacgaaaccttgagtgacgaccaaaagcgggcccaatacgaccagtttggcacgaccggctcccaagcaggcggttttggcggtcaaggtggcttcggtggctttggccagagcggcttcagccagggtggttttggcgacttctccgatatctttggtgacatctttggtgggggccgggcccggcgtgatccgtccgcaccacaacaagggcgcgacctccagtacacgatgaccctggacttcatggatgccgtctttggtaaggagacttcgatcaagtacaaccggtccgccgagtgccacacctgtcacgggtcgggggctaagccgggcaagtccgcccacacctgttccacttgtcacggccaagggtacgtccttcggcaacggcaaacgatgatggggatgatgcagtcccaagaagtctgcccaacctgtggcggtaagggccaagtgatcgacccggccgaccagtgtgacacctgtcacggtaccggggtaactgaggaacggcacgaactcaaggtgaaggtgccgcaaggaattgacgatggtcagcagatgcgtctgcagggccaaggggaagccggcaagaacggcggcccatacggtgacttgtacatcgtcttccgggtcacgccgagccgcgacttcaagcgggatggcaacacgatctacgtcgaccaagacatctcgatttcccaggcgaccctgggggaccacgttcaagccaagaccgttcacggcgacgttgacttgaagatcccggccgggacccagtcggaaaccaagttccgcctgcgtggcaagggggttccgcgggtcaacggtaacgggaatggcgatgaatacgtcaccgttcacgttaaaacgccaaagaccttgaacaagcgccaacgcgaggcgatgctggcctttgcggcggcctctggtgaagacgtgaagggcgtcaaagcgggattttttgataagcttaaggatgccttcgaagataataaataagatggttagctttcgatcattaattgtttaataaaggcgctctaaaagggcgctttttgttttgtttgcacaataatttttgctaattaagcggttttgggttattatttggatagagaatatgtagacgatgagtaacggctgaagtagggctggggttagcgatggcgtccccaatcagcaaggaagaaccccaccacgagcggggttcgggcaaaccgtactcgggagtccccttgcttatcatgcaggggggctttttgttactaatcggctacacgggagaaatgcacacaaaagagaagaaaggagtcggcccgggtgggggtcgatagagggccaatgcttgcacttattgattacggcgcgggcaatgctcatagtgtccaaaaggcgtttgcctaattgggagcaaagacggtattgaccaacgacgccaaacaagttgtttctagcgatggaatcattttaaccgggatcggcacctaccagtccgggatgaccaacttcatgcaacgccacctgatcggacccatccggcgggcggtggaacagggagttcccttactggggatcgggctcgacatggagttgctatttgattactcaacggagggcggtttaattcccggcctgggcttaattaagggccgggtgaccgaaatcccgagcaccccgcaactgccggtgccgattgtcggctggaacatgaaccggctggaaaacccggtcagccgctttaaccaaattgatgaggagtacacctactttgtccactcttattacgtccaaacggcgccccaaaacattgtcgccacggccgaatacggggtcgtcatcccgacgatcgttcaccggggcaacgtggtcgggatgcagtttcaagccgaaaagagtgggccaatgggcttgaatttattaaatgactttctcgaaggagtggtggcaaggtgagttacgtaagtaggggaggtgaagcggatgctgacgaggcggattttgccgtgcttaaacgtgattgatggtcgggtcaaaaagcgcctactgggcagcgagcgactattggacgttggcgacccggtcgagctggcctttaagtaccaggaaaacggtacggacggcctggttttcatcacggatcccaagtaggccggcggtggccaggaattgctggatatggtcgaggccatttcccaacaggtctttatgccgatgacggtcgtgtgcaacgtgcggacggtcgcggaggttagaaacctgttgttagccggggccgataaggtggggattagcacccggtcaatcatggcgccggactttattcccaaggtcgcccaggtctttggtaaccaaagcatcgtcgccatgctggattaccacgtcgacccgcgtaccaaccgcaagatcgtttgcaccccgggcaacaccgaactcgatgcttacgaatgggccttgcgggtcgtcgagctgggggtcggggagctcctggttaactcgatggaccgtgatgggaccgaaaacggcttcgataccgccttttatcgtgacttgaccaccaccctgaccattccggtggtggcctcgggcggggccggctcgacggcggactttgaagaggtctttgtcaactccggggtcaccggggcgatggccgcctcggccttccacctcgaccagatgacgattagcgaggtcaaagagaccctactcgaaaaggggattttggttcggtaagtatagagtggggaatcacctccttggcagaatcaaggacaccgctgacgcgctaacctgtgtcctatccttagcccacggcctgctttatggttggtccgcacttccctctagttcgttaaacaatcattaaggcacttcattgacgggtgcttttttagttggccaagcgtatactagtgacaattttaggcaggaggttttttatgaaagttgatggccatacccacaccgagttgtgcccgcacggcagtggtgaccacttagaagcgatggtggaacgggcgatcgagctgggctttaccgactactgggtgaccgagcacgccccgttgccggtgaactttagcgatgccttcgggggccccttagatgacatccaaaccgcctcgttaagaattgatcaggtcgatgactacctggaattagccaaccagatcaaggaacgcttcgccgctcaaattaaggtccacatcggctttgagttggattacctggccggttttgaagccgaccgccgccacttttgggaccactacggcccacaagttgacggcggcatcttgtcggtccactatttgccgggccgcgacggccgctattacggggtcgattatagccccgaggaactagagcagggctttggcgagttgatcacccagccccaggaactgtaccgctattacttcagccagttgcaacgggcggttaactgcgacttagggcccaacgccccgaagcgcttgggccacctaaccttgattaaaaagtaccaggaccgtttcggcctcgacaccgactttgacgccaccacttggcaagccattgagcgcctgttggcccaaatggtcgccgacgactgggaaattgatttcaacaccgccgggctgtttaaggccgattgcaacgatttttacccggggtgggaaatcgccgcccgggccaaggaattggggctgccgttggtctttggttccgacgcccacgccacggtcgaggtggggcacgcctaccacttgtttgaaaaatttagccaaaaggtttgaccttttaaaaaaagtggcgtatatttctattaaaatttagtgagtaaaaaatgagtaaggaccaggagagtaggagtggggctcccaagcagagagtcgccggcgctgggatggcgattgacccccgcttcgaaccacacctgggaactggacggctgaacggagtaggtcggcccgggaccacccgttagcagggttgaagttagcttcaacgtgaggcccctttcgtgagggaggggtgaacggaggtggaaccgtgctcctgtgccctcttgcagcaatgcaagggggcgttttttattccaaaggaggttgagtttgatgcaagattacaagttaccagctggcttgcgggacaactttggtccccaagcgacccaaaaggaaagcgtccgtcattacctaacgggcctgtttcaacgacatcactacaccctgatcgagacctccctgttggaataccgggacgtctttggcccctacgagttgcaggccgaaagcctctaccggatcttagaagccgatggtcaggacttggtgctacgcccggacctgaccctgccgatcgcccgctttttggtgacgactaacgtcagcttgcccaccagctttgcctacgtgggcgagcagttccgccggaaccgccagctgaccgggctttataaccaatccacccaagcggggatcgaactggttggctttcaatcacgccgggccgagttggagtgcctaacggtgatcagcgagttaaaccgggacctctttaacgggcggctgctggtggaactggggcaggccaggctagccgacctggtcttagccgacttgccggccagcgagcggcaaaaagaagcgatcaaggccgccctctttaacaaaaacgtccccgactacgaggcggcgattgccccctttaaacgggagcgccactaccccttcttggcggagtggacctggctgtttggtaaggcggacgtggtcgaaaaaatggtggcgccgctgtgggtcaacccagcggccagggaggcgatgcaggaggtgttggacctcgccaagttggtggcccagctgggcgaccaagagctcttggtcgacttttcgaccgccgcaccgcaggcttactacaccggggtgaccttcaaggcctacgctgaccaaaccagtacctacctggtatcggggggccgctacgataacctcctggccaacttccaggaaaagagcgaaccggcgattgggctggggattgacgtaaccctcatcgcccagctgttggaacggagcgccccgagggaccaagcgaagccaaccctagtcttttgccaactagccgactggccgacctttgccaagcgctacgggggggatcctgcctacgaggcctgtctggccgacagtttggtagcggcccgcacccaagcagcggcaaccggccagcaacttaaagtcatgaacgaagagggggacttaatcgatgcttaaaatcgccttaaccaaggggcgggtggaagaacagttcaccgccctgctggcccagcggggctttgacaccagccccttagaaaacaagcagcgccgcttgatcatcgaagtggccgaccagtttgagttcatcctcgccaaggggccggatgtcttaacctacctgaccaacggggtggtcgacctggggatcgtcggcagcgacatcctgatggaacaagacgccgaaagtgacgaactcttggacctaaaaaccggtcagtgccaatttatcctggcttcaaccgaagactttgaccccgaccgcccgggacgcaaggtgatcggcaccaagtacccccgggtcgcccaacgctactttgctcgccgcggccaagacgtcgccatcatcaagttggaggggtcggtggagttagcccccttaattggcctggccgacgccattattgacatcaccgaaaccggccggacgctgaaggaaaaccacctagtcatttacgaccgcctcgatcaggtttcgacccggttagtggccaacccgctggccctcaagcaaaaacgggacgagatttaccgctttgtcaccaccctcaagggaggaaactaacatgaagatttaccaaaagaacctcaccgaaatgaagcaaatcgtggacgactacaccagcgccaccgtcgacccccagattgtcgcaacggttgccgagatcatccaaaccgtccgccaagaaggcgacgccgccctccgcaattacggcgcccagtttgataaggtcgacgttaaagagtttgcggtcccacaaaccaaactggaggcggcctaccaaaccctgccgtcaaacctcaaggacgccctgaccaccgctaaggccaacatcactagcttccaccaacaagaaattgagaacggctttgccgatttaaccacgcccggggtggtgcggggccaaaaggtgacccccttagcccgggtgggcctctacgtgccggggggcaccgccgcgtacccgtcgacgatcctgatgaacgcgattcccgccaagctagcgggggtcggtaagttggtgatggtcacgccgccgcaaagggaggggatctcccagacggtgctggccgccgcctacctggccggcgtcgacgccgtttaccaagtcgggggtgcccaagcgatcgccgccttagcctacgggaccgaaagcatcccgcaagtcgataagatcgttggcccggggaacatcttcgtcgccaccgctaagcaacaggtttttggccaggtcgccatcgacatggtggccgggccgtcggaaatcgggatcatcgcggacagcaacgccaacccggacgaagtggcctccgacctcttatcgcaggccgaacacgaccggcgcgcccgggcgatgctagtcaccgacagcgtggaactggccgaggccgtttccgccgccgttgaccagcagttaaaaaccctgccacgtcaggaaattgcccaagaagcgatcgccaaccgtagcttcattgccgtaatggcggaccaagacgaaatgtttgaactgatgaattcgattgccccggagcacttggaactccaggtccaggacccgatcaccgcgatgggcaaggtgcaaaacgccggctcggtcttcttgggccgttacgcctccgagccgctcggcgattacctagccgggccaaaccacgtcttgccaaccgggggaaccgcccgctttgcctcaccactaggggtgtacgatttcgttaagcggacccagttcttgcaatacaccgaagccgccctggccgaggtggtgcaagaagtcgccgacttggcccgggccgaggggctggaggcccacgcccgcgccgttgaagcccgttttaaggagggagattaagatgcgaactgccaccattaaacgccaaaccaaggaaacccaaatcgaggttagcctcaacctggaccaacaaagcgggatccaaattgataccggggtcggctacttcgaccacatgctgaacttgttggccaagcacggccgctttggcctggtggtcaaggcaaccggtgacctagaagtcgacgcccaccacacggtcgaagacactgggattgtgcttggcgagaccctcaaggaggcgctgggcgacaaagtccaaatcgaacgctacggcgacgccatggtgccaatggacgaaaccctagcccaggtggtcgtcgacctgtcggggcgctcctacctggtctttgacgccgaactgaccaacccgcggctgggtagtttcgaaaccgaggttaccgaggactttttccaggccctggcctttgccgccgagatgaacctgcacgcccgggtcttgtacgggcgtaacacccaccacaaaatcgaagcgctctttaaggcgaccggtcgcgccctgcgccaggcggtcacgattaacccggcgattgagggggttaactccacgaagggggtcatttaatgcttgcgatcattgattacggggctggcaacacctataacgtcgaaaaggcctttgcctacctgggggtgcaggcgaccttaaccgccgacccggctaaaattttagccagcgacggcctgatccttcctggcgtcggcgcctttaacgcggcaatgaccaacttgaagcaacgggggttggttgagccaattaaagaagcggtgaaaaagggcacacccttcttgggaatctgcttagggatgcagatgctctttgattattcgaccgaatacggccaaaccgctggcctcggttttatccccggccaagtcgtggagttgcccaagcaaccgggcctcttggtgcccgaagtgggctggaaccaaaaccgcttggtcaacccggcgagcgcctaccggcaggttgacggggaatttacctactttgtccactcctattacgcccagacgccggtccaaaacgtcgtctcggtcgtcgattacggggtactggtgccggcgatcgttcaaaaagacaacgtggtgggaatgcagtttcaccccgaaaagagcggcacggtcggcctcggtttgttagagcaattcttaaagggggtagaaaaatgattaacccagccattgacctgcagggcggccaaagcgtccgtttgaagcagggcgattttgaccaagcgaccctaattgaaaacacccccctggcccaggtagaacgctttcaggcggcggggatcgaccgcctccacttagtcgacctggatggcgcccgactcggccacccggctaaccaggcggtggtcaaagcaatccgcgactcctttaccggcatgatcgagctgggcggcgggatccggaccgcccaggcggtcgccgactacttaaagctggggattgaccgggtcatcttgggctcggtggccgtcaaggacccccagctgacccgccaggtgttaaatgactggggtagcgcccggattgtgatcggcgtcgacggcaaggatgggatggtggccacggaaggctggctcagccagtcgacggtgccaatggcaaccttaattggccggctggtggaagcgggcgccgttaatttcattgttaccgacgtagcccaggacgggatgatggcaggtcccaacttgaacctgctcggcgacttgcaggcccagttcccaaccgccaacatcattgcctccggcgggatccgcaacctagcagacattgacgccctcaagcgagtcggcgtcaaagaagcggtcgtcggccgggcaatgtttgaggggacgctgacgctcgaggagattaaggaggccaacgccaatgctgactaaacgaattatcccctgcctagacgtgaccgatggccgggttaaaaaaggggtcaactttgtcaacctggtggacgttggtgacccggtagcgattgcccgccgctaccaggaacaaggggccgacgagctggtctttttagacatcaccgccactaaccagggccgtcaggcgaccgtcgacatggtggccgccgtctcccggcaggtctttatgccgctaacggtcggcggtgggatccgctcagttgaagacatgcgggccctcctgttggccggggctgataaggtttctttaaactcctcggccgtggccgatccggacctgatcagtgcgggcgcccgcctgtttggtaaccagtgtctcgtcaccgccattgacgtcaaaaccgacccggcgaccgggcaaaagatggtttacacccacgggggaaccaagcccaccggcctcgaggcgcttgcctgggccaagcaggtcgtttccctgggctcgggggagctcctggtcacttcgatggacaaggacggcacccagaatggttacgacaccgccttttacaaggaactaacggcggccgtcgacgtgccggtgatcgcctccgggggggccgggaagatcgatgactttgccgacgtctttttgaactcgggggtcaccggggccctggccgcttccgtctttcactttcagcagctaacgattgcccaggtcaaagaggacctgattaaaaagggggtgccggtccggtggaaccagactttacaaaggggctcttaacgacggtggtggtggacgcaaccaccgaggacgtgttaatggtcgcctggatgaacgaagcgagctaccggctgaccaagcaaaccggggagacctggttttggtcacgctcacgccaggaactctggcacaagggggcgacttctggcaacacccaggtcgtcaaggaaatgtggttggactgcgaccaagataccctcttggtcaaagtggacccggccggcccggcttgccacaccggggcacggtcttgttttttcaaccaggtgcagggaaaggaagattaagatgcaagatttagaaagcttataccaaatggtcgccgccagaaaggccaaccccaaggaggggtcgtacaccgattacctcttcactaaggggttagacaagattttaaagaaggtcggcgaggaaaccaccgaggtgattgtggccgccaaaaacgaaggcaccgccgagctccagtacgaaacggccgacctcttgtaccacctgatggtcctgctcgttgaacaggggctgacctacgatgacatcaaagaggagctaggcaagcgcgagggcttgatgagcgacttcaaggaccgcccggagattaaggacttataagggggtaggggaatgaaagcagggatcaaccaaattcaaagctacgtgccagaagaaccggttcaacgggttaaaagcaagtaccacttaaagcgcctggcccgcctgtcggccaacgaaaacccgtacgggacctcgccgttggttaaagaggccctgatcaatgcgattaacgacggggcgctcaaccgttacccagacggagacgccagcgagttacgggccctggtcggccagcagttaaacgttgccggcgaccagctggtctttggcgtcggcctcgacgaaatcatcgaattggtggcccgcgcctttttgaccccggacgatcaggtggtggtcgccaagcccgccttttccgagtacgcactgcacgccacggttgagggggcggccgtcaaggaggtgcccgttaacccggcgaccggccactttgactttgtcggcgccctggccgtgattaacgaggcgacccggttggtttggatctgcaaccccaataacccgaccggggtcttggaaagcccccaggcgattgaggacttcgtgcgccaagtccctaaagacaccctggtgttcattgacgaggcctacttggacttcgctgacgacccggccaaggcgacctgcctgccgctggtcaagcggtaccaaaacgtggcggttttaaggaccctttctaaggcctacgggttggccaacgtccgggtcggctttgccgtgatgccggtcgcattggcggcgattttgcaaaagatccggctcccttacaacctcaacaccctggcccaggtagcggccgtggccgctttaagggaccaggacttcgtcaaggaagcggccgccaagaatgcggttgagcgggccaagtgggaagacttctttgaccagcagggggttaagtactttaagagtcaggctaacttcatttacttcacggtcaaaaacgccgctgacctggcccaaaccctgttggagaagggcttccaggtccggcgccacttgcaaccggactggctgcgcctgacgattgggcccgcagaagacaccaccgtcatgcaggccctggtggccgattggctcaagcaacaagcataatttggcgccggcgggcggtctttgctatactagaagcagactttacggaagaaagtaggcatagtgcatggatttagcagcaatgaaggaacgccaacagcgaattcgcaacttttcgatcgtggcccacatcgaccacgggaaatcgacgctggccgaccggattttagaaatgaccgacacgatcagcaagcgcgaaatgaaaaaccagatcttagacgacatgcccctggaacgggaacgcggaatcacgattaagttaaacgccgtcgccctgacttaccacgcccaggacggccaggattatattttccacctaattgacaccccgggtcacgtcgacttctcctacgaggtgtcgcgctccttggccgcctgtgaaggggcgattttggtcgtcgacgccacccagggggtcgaggcccagaccttagccaacacctacctggcgatcgataatgacctggagatcctgccggtcatcaacaaggttgacctgccgtccgctgatccggaggggaccaaaaagcagatcgaagacgaaattggcttagacaccgacgaggccgtcgacatctcggctaagaccggggtcaacgtcgaccaggtcttagaaaagatcgtccaagacatcccggcgccgaccggcgatttagaggcgccgctcaaggccctgatctttgactccaagtacgatgactaccgcggggtggtcttgtccgtgcgggtcaaggaggggaccgtcaagaagggcgataagatcgagtttatgaactcaaaggcggtttacgaagtggccgaagtcggcatcaactcgcccaaaccgctggcccgcgacttcttgatggccggcgacgttggttacgtgaccgccgccattaaggacatcaaggacgcccgggtcggggacacgatcaccgacgccaaccacccgaccgataagcccctggccggttaccgccagatgcagccaatggtctacgccgggctgtacccgaccgacaacgccaagtttaacgacctgcgtgacgccttagaaaagctccagttaaacgacgccgccctgaccttcgagccggaaagctcccaggccctgggcttcgggttccgctgtggtttcctcgggatgttgcacatggacgtgattcaagaacgcttggagcgcgagtttgaccttgatttaatcaccaccgccccgtcggtgacctatcacgtcaacttgcacgacgggtcaaccaaaaacgtcgaaaacccggccgaaatgccggacgtcaccgagatcaagtcgatcgaagaaccattcgtcaaggcctcgatcatggtacctaacgattacgtcggcgccgtgatggagctgtgccaacgcaagcggggccagttcgacacgatggaatacctgtctgacatccgggtcaacgtgatctaccacatcccgctgtcggaaatcatctacgacttttttgaccgcctcaagtcctcgacgcgtggttacgcctccttggactacgagatcgacgattaccggccgtccgacctggtcaagatcgacatcctcttgaatggggaccgcgtcgacgccttgagcttcatttcccaccgcgactttgccgaggaacggggccgcgagattgcctccaagctcaagaagatcatcccgcggcaaaacttcgaaatcccggttcaggccgcaattggttccaagatcatcgcccggaccaacatcaaggcctaccgcaaggacgtgaccgcccggatccacactggggaccccgaccggcgggccaagctcttggataagcaaaagcgcgggaagaagcggatgaaggccgtcggcaaggttgaagtgccgcaggccgccttcatggccgtcctgcagacggatgaagagattgataattaagaagtgcgacccaaccataaagcaggccgtgggctaagctagggcaagggttgatgcgataagcatcgttcattgcccgtacttagccactaggcctgcggttggggagcatgttatctgtgtaacctagcacgcaaaaacgccccacgtcgcaaaatgcggcgcgaggcgttttgttttcttataaaaaccaaaaggaggagccaaggtcgggctcctcctctcggagtatgttaggttatcatacggagtgtagcaagattgggagaatcactatcactctacaaattatattatcacaaataattaaaaagtaaaaccagggaaatgtaatgatttttattgttgataattaatttatttatttatggtttataaactacttgtttaccaaagacaaacgggttattcctttttgtaattaaggaaaatgacgttatattcgccgctaaagatgtctattaagtcgcacacatcaccataaaatattatgatatttttgggtaaaactgctagttgcttataattgttccgttggggtagacccggaggctcagcgcggtcccggtcatcgagccctcgaccatcgcttgtttggaaattgccttgacgaagtagctgccgtcctcgttttgggccggttgctcatccgattggctcatgatgacccactggtagtcgccgttatcatccccgtagatcgattcggccagcgccagggcttcttcggcgttgtggacgacgaccccggactggctactgctttggctggcgttactgggctgggtggtgggcgcagtgatccccgccgccgaggcggtcgcaaaaggggcgctgaccgtgggggatgcaccggtggacgttaagctagccgaagtgatagcagcggcccgttgttggctactgtggctacttgaggcttgactagaccgcttgcttttgacctgaccgcacccggttatgccaagcaggaatccgctaagcaatagggcgccgatcaattgttgttgcttcataaattatctcctctcgcccccattttagcacggcgctaaaaggccgggctggcgctgcggttatagtaaactaggtgctggtcgccgctagtggggtcaactaggattttggtgacgctgcagttggcgggttctaaaatcgtcaggtcgtgcgactgggtggcgttaatggcaaaggagcggacggtgaagccgtgggtgacgacggcgactcgttcgtcagggtgggccttagcgacctcttcggtgaaggcttgcacccgggcttcgacgctggcaaagatttccccgttagcgaccggggcgtaggcggcccggacgtcgttgattaggggatcaaagaggtccgggtacttagtcatcaagtcggcgtttaactggccgtcccaatcgccgtaggaaatttcgagcaagcggtcgtcggcgaccattggcaggtgggccgtttggttaacaatctgcgccgtttcaaccgtccggtgcagaggggagtggtagagggcggcaaaaccagtcaggtccaaggcgccggccagttccttggcctgggcgatccccgtttcagacaggtaggtacgctcgtcgtcgatcgtcccctgcttgagcccggcgacgttggcagccgtttgcccgtggcggataatataaagttcagtcatgagaaatcctccgttctttttcaaagattatagcaaagattgtcgccaattcgggtaagaaagcgtattctggagggattttgatgacacgttacttacgtaaaatcgcggtttcagacgtcgggatgggctgcatgggcttttctcacggctacggaacggtgcccgaccatgacgaagcagttgattccatccgggcggcctaccaggcggggtgcaccttctttgacaccgccgagggctacggcaaggagcgcttcttccccggccacaacgaataactggtgggtgaggccgttcaccccttccgcgaccaggtagtcttagccaccaaggtccggattgaaccagaagaggtggccgaatacggcgtcgaaggggcgctgcgccatcacttagccctgtcaatggaaaacctgcagaccgactacgttgacctctactacctccaccgggtcaacgaggacgtggccctcagtgacgtgtcgctggcgatgtgcaagttaatcgaccagggcctgatccggggctgggggctgtcgcaagtctccttggacctcttaaaagaagccgaccaggtgacgtcggtctcggccgtccaaaacctctataacatgctggaacgtgactgcgagcaaacgatccagccctactgcttagaaaacgggatcgggctggtgcccttctcgccaattgccagcggctttttatctggccaactgcacagtaccagccagtttgaaaaagtggatgacgtccggaactgggtgccccaactcagccaggaaaacatggataaaaaccaaccggtcatccacttactcaaccagttcgccgaggccaagggggtgacgaccgcccaactttcgttagcctggatgctggctaagtaccccaacgtggtgccaatcccgggctccaagaaccgggcgcggatcttggaaaacttagcggcggctcaggttgatttggccccggtcgaaatgcaacggctcgacaccgccctgaacgagttgacgatccacggccaccgggggacggtcgaggtcgaaaaccgtcaggtcggctataaccgggccacccacaccaagtggactaattaacaaattgatgattgacatttgatgagagttcccttagaatttacttaacttaaaggaacgaacaaaggaggaaacccagatgttacaattcaatcgctacaacttagtttcctcatcacggtcttcacgctaacgaaggccgtcctttagggttggccttcacctggtgggggctgaccttggtaccgtggtacaaacgggcccccgccaaaagaggtgggggcccgttttttcatttggaatcaaggaggaattgccatgccaacctacaacttcgccgctggcccagccaccttaccccggccggtgctagaacaagtccaacgagagctcctggattacaagggtagccaagtaagcatcctagaaatctcccaccgctcgccggtctttcgagaaatctaccagcaggccaaggaacggctcttgcagttgatggggctgagcgccgacgagtacacaccgctcttcttgcagggtggggggaccctccagtttacgatggtgcccttaaacctggcccgtgaccaccaccgggtgggctacgccgataccgggcactggtcggcccgggcgattgaagaggcgaagaagttgccggacttgacggttgacgtggtcaccgaggccggaccggacttcgcccacattccggcggtgccagacctaccagctgacacctacgactacctgcacatcaccaccaacaatacgatcatggggctggcttaccgggacctgccgcaaacggcggtgccgctggtcggggacctgtcctccaacttcttgggccaggcctacgacttttcttcctttgacctaatctacgccggcgcccagaagaacctggccccggccggggtgacgatcgtggtggtcaaaaatgactacctaacggaagaccacggcctgccaagcatgctcaattacccggccctggccaagaaggaatcggcccttaacacgccgccggtctttcaaatttacttcgccaacctggtcttgaagtggttaaaagaacagggtggggtccaggccatggacgagttaaaccgccaaaaggccggcctggtttacgattacttagaccagtccaagctcttctctaaccgggtggcgccggattcaaggagcctgaccaacattcccttcaccactgggaaagccgaccttgaccagcgcttcatcaaggaagccgccgcggccgggttggtgaacttaaagggccaccgcttagtcggcgggatgcgggccagcctgtataacgccatgccactggccggggccgtggccctgcgtgactttatgcaccagtttgaacaagaaatttaggaggggcgcacatgtatcaaatcaaaacctacaacgcgatcgccaaggaaggcttagacacctttaaggaaaactaccaggtcaacaccggtcaggaaccggacgcctacatgatccgcagcatcgacctgcacgactaccaatttgaaccggggctgctagcgatcgcccgctgcggggccggctttaacaacattccgctcgacgcctgctccgaacaggggatcgccgttttcaacaccccgggcggtaacgccaacgcggtgaaggaagtggtcatcgccctgatggtcatcgccaaccggaacctgatcgaagcggccaactggagcgcccaaaacgttggcgaagacatctccctgcgcaccgaacgcgaaaagtcgcgtttcaacggccacgaactcttcggcaagcgcctagccgtgatcgggatgggccacgtcggttccttggtcgctaacgccgccattgacctggggatggacgtgattggctacgacccctacctgtcggtggacgccgcatggaacttgaccgcccgggtgcaacgggccgccaccctggctgacgcggtcaagggggccgacttcatcaccgtccacgtgccgaaaagcgaggaaacgaccgggatgattaaccaggaactgctcgcccaggttaagccgggcgccatcctgtttaactactcgcggctggggattgtcgacaaccaggccgccgtggccgccctggccaatggtcaactgggccagtacgttaccgacttcggcgaggactgcctgcaggacaacccgaaggtcacgattaccccgcacctggggggctcgaccaaggaagccgaaatcaactgcgccaagatggccgtcgacgaactgacccagtatttggagaccgggaacacgaccaacgccgtgaacctgccggacgtggtggccccgttcaccagccagcaccgcttcacgatcattcaccgcaacatccccaacatgttagggcaaatttcgacggcgatcgccaaggccgaggtcaacatcgacaacctggtcaaccgggccaagggcgagtacgcctacacgatggtcgacgtcggcgaattgaccgccgaacaaaccgagattctaacgaccaccctcaatcagattgacgccgtcagccgggtccgcttgctggatcggccaaaacagtaattaaaaataaatccccgtggtatgccaaggcgaaccgcggggatttttaggtgggacgcctttgaagttgatttataattaacaaccatttagaatgggtgggtaaagttatttataatttaacagcaaggagagaagcatgaagaacgagatcgaacagttaaaggacgttctgcttgatagtgatgcaatcttaatcggcgccggatcgggaatgtctgcggccgctgggatggactggtggtaccaggccagcccggtatacaagcagcacttcggggacttttatgcccgccacccggaggcgaccgggatcttcaagggcttttatgcgcggtttacgagcgaaaatgagcgctgggcctacctggtacggatgttggactttatctaccaccagccgccggtcaagaatacctaccaagttttaaaggacctaattcaagaccgcccctaccacatcttgaccacgaaccaagacgcaatgtttaaccgctactttgccgacgagcaaatcagtacgattcaaggggattggcgcttcttgcagtctagcgccccgcagattgacgaccagctttacgacgcccggccctttgttaagcgggggatggaatacttggcgcaacaagaagataagttgtacttgccagacgatttgattccccacagcccgacaactggcttgccgctaacgccgtgggtgcggtcaccagaatttttggaggggcgccggtttaattaatattagccggaaatcccgtgactttagtcatgggatggataggtcactattgagcccctttatggggctttttgtttgtttctgtatattttttgtcattgtcatctgcaacttgctgcaagatagctttcatttcgttagctaagacctcggttgtaaaagtctgattgcgatacttagttacccagatcaaatgataatggaaattatagatataacgacgagtataaatggcatctctgattttttctttagtcataatatgctctcctttgttaatacattgacatcatgatataatcttgatcatatcaataaaggaggtgaaatcaaatgaagtcaatggcaaaaatgaaacatcattatggcctaaaaatgcgctgctatcctagtgaccaacaaaagcagttgattaaaatcaacagtgacgctagtcgctttatctataacgaaatggttgcgatcaataaggaactgatgcagtttcgcagagttaagctaccgattgacatagttcaggatcgtattaagcaactaactatgcgccaaaacgctaagcaaatgtctaatcactatcaattcttagaagataaacgaattgatagtttgacgaaagctaatgccattcagaactatcgaaaagcttggaatgcttttcggaaggttcacgccactggcgttcccaaatttcatcgaaagagttatcactggcggtatcaaaccaattgtcaatacccggggcaaaaaactgcgttgctaactaacggtacagtctgttttctagataatagtcatgtcaaagtacctaaaataggactgttacgtgttgccggttcgcaagcacggcttttgaaaagaatatgcgagactagaattggtaccgtgacgttgactaaagattcagcggatcgcttctttttatcaatgcagttagcttcagatgaatcttttgttaaagtgtccaaagctactcatggacatgttggaattgatcttaatactgataacttcttaaccgacagtgaaggcaacatagttcctaatccacgatattaccgcactattaaaggcaaattagccaaagaacagcgcattttatctagacggcaacaacgtgcaaaaaaagaacatcgttctttacgagatagtaaaaattatcaaaaacagcgcttgttagtcgctaaactccatgccaaggtaatgaaccaaaggcataattttctccaacaaatttctaccgcattaatcaagaaccacgatttagtagtagccgaggagttgcgtagcaagaatttgcttaaaaatcatgctttggcacttagtatttctgacgttggctggcgaacatttcttggcatgttggcttataaagcaaagctttatgggcgtcaatttatcacaatcaacccaagaaatactacccaaacatgtcgcgattgtggctttgtaatgggcactaatgggacggacaaactaacattagatgatagaaactggacttgtcctaactgtggtattcaccatattcgtgactggaacgcagctaaaaacattcttgataagggaatagctaaactagcctagcttatctgtccctatggcaacctggggacataaaaggcgttggtaattagacgaccgctatttgattacaatttcagttagtcaaataagttgtccctatctacgcaaattgtggttcgaaatccgtgatgatattcggctcacaagccactgactttagtcagtggtggttgacacaagaacacgaaaagacccgccaattcatcaaccggtttggcaaccaaaagttgttattctttgagctgggagtggggcgaatggcgccgatgtttattcaagaacccttttggcagttaaccagtcagctccccttggcccactacgttaacattaatccccaagacgccatgacccatacccagattacaagccggtcggtgttgatcgacgccgacgttgatcaggccttgcgggcggtacaaaaactaaaaagtcaaaacccggttagtcaccaaagttacttgaaaacaccgagggtaccaaagcaagagcctgaacaacaagcccttggaatgcttgaacaggccccggccttgttaattacggcagccaatgggttttcgattagcgagggcttcaactggtttgcaagtgacgctgtctttcatgacttattgggcgacttggttgaccaatacggcctccataacatgttagaagccgtccaatacccgtaccagagtaaggtggtgcagtggcgggtttgggcccggataattaatcgttactccagccactaccacaccagcccgttgatgggaaacttacgtcagattatcaaggggcgcccttattacatctggaccacgaatccggaacatcattttaacctagccggtttagatcacgtggtcgaaaacgaggccaactgggtgtatggaagttgtcagacccctgatcaccctcacgttgacctacgggcggcggccaggttaatggttggactcaaacaagaacgggagctgaccgaagcagacttgccacggtgtacgacctgtggggaggtgctaacgccgctaatgtttgcgccaaagccacaactagattcccaacaggtggcggggttaaacaagttggtcagggcgcatgccgatcaaccactggcggttttggaactgggggttggtgatcagaacccactagtcaaaaagcctgtggaaagcttgctccaccagtttagcgagtggaactacgtggtgctcaaccaaaagccgggcccggttccctttaacctccaaccccgcacggccgtgatccagggggatttgaaaacaaacttggcccaattagcgcgtttgatggctaggccgagcaaagcgcggtaagataagaaaatgatacttgcaggaaggggggaaaagaatgaagtattccaccaggtttagcgatgcaattcatatcgtagtctttattgcggcgggcggcagcgacggggacctatcgagtgcggcgattgccaagtccctaaataaaaatcagacccaggtccgccaaattatggctcagcttaagcggcaccacattttggacagtgtccccggccacgtttgtccccagttagttaaagatcccgctgaattagatttggcgaccatttacctggccgttgacggcggggacttattgcacttcaacaatgaaactaatacggagtgccggatcggggaggggatgcccgacgcgttggacctaatttttggccaggtccagcgagcggcgttggctaaactggctacttattcgatccgagacgtgcttaaccaattagacctttccttgcttaacttcccgccggaaaaacaagaaactccaaactaagaccggacaaatatttagatttgcgcaagttagaggagcacgttatcttgcgcaaattcgcagatttgtcgggtgtccatcagccagctcactaccaaagaaaaagtaaaaccggtcacttcgcacttaagcggagtggccggttttgctttggttttcgttaccctagttgttcgtttaagctaatcatttccagcagcgattgggcagtcatcgaaccctcgttgccgacctttaagccggcccgttgcatcgcctgttcgatcgtatcggtggtcaaaatcccgaaggtcaccggaatcgtgccctgagcatttaagttcatgattgcgctggtggtggactggcagatcaggtcgtagtggtcggtttcgcccttgatcacggcgcccaaggtcatcaccccggcgtagcggccgctggcgaccagtttcttggcggcaaaggcgatttcaaaggcgcctggcacccagacgaggtcaatttggtcgtccttgatcccgaattgctttagggtccggatcgccccgtcggctaggttgcgggtgacggattcgttgaatttaccaacgacgatcgcgatcttcttggtgggggtggtggtaaagtttccttcgaattggttaggcatgttgttcttcctccgtgagtttgagtaggtggtgcatcttttcttgcttggtcttgaggtaggcgcggtcgtaggcggtcgccggcatttccagcggcacccgggctgcgaccgtgatcccggcttcttccagttgactgatcttatcggggttgttggtcaggagtttgatggttgaaacgtggagcgcccttaggatgtggctagcggcctcgtaggtccgttcgtcggcggcaaagcccagttggtggttggcttccacggtgtcgaagccttcttcttgcaggcggtaggcccgtagcttgtttggcaaaccgatcccgcgcccttcttggcgtaggtagatcaggatcccggtgccggcctggtcgatggcctccatggcggcgtggagttggggcccgcaatcgcaccgcagggagcccaagacgtcgccggtgaagcactcggagtggacccggaccaacggggtagtcgtggtcgggtcccccttgatcagggccaggttgccgtcgtcaaagtggcgtagggtaaagtcgccgtacgcgctgggcaggtggaccggcgggaccggttggctgaccaccgaacgccggtactcttgcagttctttgacggtcaggatcggcaaccgcagttcctcagccatcttctctaagaccgggcgccgggccatgtggccgtcggcgtcgagaatttcgcagatgtagccggcaccaggctcactagccaactcggccaggtcgacggcggcttcggtgtggccgttacgggccaagacgccgttctccttggcgatcagcgggaagatgtggccggggtagtaaaagtcgtcgtgggtgctggtggggtcggccagggccttgatggtggcggcccggtcataggccgagattccggtgctggtcgacttgtggtctagggaaaccgtaaaagcggtgtggtagggctcggtgttgtcttggaccattaaatccaggcccagctgcttggcgatcgcttcgctaaccggggcacagagcaggccgcgggcgtgcttggtcatgaagttgaccgtcgccggggtgacctggctggcgattcctaacaggtcaccttctgcctcgcggtcttcgtcgtcggtcatgatgatcaggcccccgtttttaaggtgggtgagggccgcttgaatcttatgaacgtccatttaaaatgcctcctaactgtgcggcaacgtacttgcctaatacgtcggtttctaagttgactaggtcgccaaccctaagttgatccaggttggtaacggtctgggtgtgggggatcaggccgaccgagaaccagtcgtctgcttgcttcatgaccgtcaagctgaccccgttgatcgccacgctcccctggctaatgacttgcccccgcaactcgtcagggagcttaaaggtcaattcaattgcgttttcgttaacctcccgtttgatgaccggagtcgtttggtcgacgtggccggtgacgatgtggccctccagccggtcgccgatctttagcgagcgctccaagttgaccagggcaccaactggcaggtccttgaaggtggtcaggttgtaagtctgcggcatcagggtgacggtcagacggccgggttgttcggtctcgaccgtcaggcaggttccgttgacggctaacgacgccccgacttccattccctcttgcagggcggggtcgaggtcgatcgttaggcggatggtgtggtcggtttgctcaatctgggtgagcttgcccgttccgtttactaagccagagaacattactcgtcattcctttcgtcaatccggatgtcatcaccgagttgggtgacggtgcggtgggtaaaagcggtgccggccgggaactgggccccggccaggccttggtcgccgatgatttgggggtccaggtaggtgattaactggttgaccgggaccgcttgaaatagttcggtcaaaaccgcgggaccgccctccacgtagaggctttgcaactcggcttctttaaagtagtcaagtaactccggccagtcgccgttttgcaacagtttaacggtcacgtgagcgggccagtcgactttcgtggcggcccggttggtggtgactaaccaggttggggcggaagcatcggtgaagacaaagcggtcctggtaatcgagcaggcgccccgcccggtccaagattacccggaccggggggaagagttgcggcgtctcgcacagcaggcgtgggtcgtcggcaagcacggtgccggcgccgaccacgatcgcgtggtagtcagcgcgttcctggtggaccagccggcgggcggcctggttagtgatcgccgtcgcttgccccggggcggctgcaaccttgccatccaaggagagggcctgcttggccgtgatccagggccactgctggcggtaaaagtagaagtagtggcggttgagggcctcggcttggtcctttaagagtccgacctccacatcaattccggccgcctttagctgggcgattcccttgccaccaacgacttggtgggggtcaatcgtggcgacgaccacccgggcaaagtggctgtcaattaacaactggctacacggaggctgcttgccgtagtgaaagcagggctccagggtgacgtaaatcgtggccccggccagctgttcgttagaaagcttactgatggcgtcgcgctcggcgtgggcctgaccatactggtggtggtagcccgtcgccagcagctggccgtctttgactatcacggcgccgacctgggggttcttccaggtggcgctcccgcccttggccgcttcagcgagcgccagttgcatgaactgttcgtctgaactcaaggtaatgacttcctttcataggtgagtgggaaccaaactcctcggcccgccgaggagtttgccattcccatttccccgggaaatttaaaaggggccccggaaaaattccgggacccctggttgaaagcgtgttcaaaaaggtggcaggggacttccccctgccttttcttctcccatccagactttcactgtcggtaccagaatcgcactggttcagccgcaaatttgcgggtcacggacttcaagcattgcttgtcaccgtcggtcgggattttcaccctgccccgaagaaattatttatttaattgactacattatgctgggaaacggttcacttgtaaaggatttttttggtaagggcttttctgaaaatgagcggcgcccttagaaataaccgctccggctaccaactaaattaagttcgccttggtcagccactgcttcgcctggcgctggttgctcaacacagtgccggggatgatcgtcacctggtggtgggtttgatcaacgacgcgttggatatagctttgactgcgctgataaccggagccccccgaggtggcaaaggtggccagcgttttgccatctaaaggaagttggtcaatggcgttagcaatcaaacggggcggaattccccaccaaattgggtggccgatgatgatcgtgtcgtattgatcaagggccggaaagtcgttgacgcaggcgacgtgcccctggtgttcgtgttgctcaattgaggtccgtgactgagggtcatgccagtccaggtccgcttgggtgtatgggtcttgggccttgatttcgtgaaggtcggccccggttaagttggcaatcgtttgggccatccgtttggtggtgccggatgctgaaaagtacaagacgagcgtagttgccattaaaatccctcataatatttaactattttaattatattacaattaaaaaggttcttctaactacttggctgaccctttgctaggtaggtagacggtgaaggtggtatggtcagcaggattcgaaaccacggtgatgcgtccctgatggagagcaataattcggctggcaatggcgaggccaagcccaagcccgccgacgttggaacgattatcggcttggtaaaatttttcaaacagatggtcctggtcagtgggtgagatcaggggaccgtcgttgttaacggacacggctatctgatcgtcgtggcgctcgattttaatcgttaggtgcccccgtctggtgtgaatttgatggcattattgattaggttgacccagacctggttcaacaggttagcgttcccaaatgcggttgccggagcaagcgttaggtcaacgttaagcttgtgttcttctaattggggccacaggaggatgacagtctgacgaacttgctcagttaggtcaaacgaaggctggttgtttaaaatggtttgactctctaacgtggttagggtcagtacgttggtagacaggttcgttaaacgatgggcctccttactaatcaaagccaggtaggcttgccgctctttttttggtagctcccgttcttgcattaggtcggcaaacccctggattgaggcgatcggggtgcgaaattcgtgggagaactggttgataaagtcgtcgcgcaaagtggcggttttagcgagttggtcagtcatttggttgaagttttggtagctggctgacaggggaccacccttttgctcatcgaggtgggcagcaaaattcccggcggccacttggtcaatatcctttgttaagtaggtgattttttttgttgagccaagaaaaggttagggctaagaccaccgttaagataaccacggtggggcccagggccagcactgggttaagcgggtcgaaattgcgggccaggtggggaaaggtcagcattaaagcaaagtcaaatgccagggttcccatcacgatcaaaaaagcgatcaaaacaactagccaggtgaggacccgggtaaagggatttttagtcatgacaaatttctcccttgtagccgaggccacggatggtggtgattttcacgtcgttactatccttaagtaacttgcgaacctttgagacgtgggttttgacggtgtcttccgttgaggccgaatcaattccccagatctggtcgagtaactgggcctgggtgaaaattttattggggtaggaaagcaaggtgaagagaagcaaaaactcctttttggctagggtggtggagtggccattgatggtcaaagtaaaattctcttcgttaagaatggtctgaccgattgtaatctggcgggcactgttaatcttagcccggcgcaaaagggcggccacccggagcttgagttcggctaggtcaacgggtttggtgaggtaatcgtcggccccactagtgaagccggtggttttatcggtgattgtggttttggccgtcagcatcaaaacgggttgttcaaacccggcggcccgcatttccttaaccattgtgaagccgtccatggtgggcatcatcacgtcggcaattaaggggtcgacacccccttggtaaagcgccactagggccctgctaggaccgatgttttacgggatgctggtaccagccttgagcgccattttcattatcattatcattgtcggcaacaagctgctggccggccaggttgaccggggctcgatggcctacctgttgacggcgctggttcgccggctaacggtcacgctgacccaaacgctgtactttattggcgcgttggtggtgacctttggctcgatgacggtgaccagtttgttggtcaaccattacgcagaagcggggtttgcaaagaaaattttggttgaattaaacttcggcgccctggcaattgcctttgcctttgcgggaatcatgtttttagcctcgggggtgtttaacctctctaagctatccctggggaccggggggtcttaattttagctttcatcttattagccgtgattgcttcttttgtcaactacggggtcagtgggttggatgacgtttaacacctgacgattgtatcgctgtttgattacaaagacgttatggcccaaggagatgcttggcaaggaaaactggcgattttaggcgggctaggcgccgtttgctttacggggggcaacctcgcctttaacaaaaaggatttaccgttataaagattaagaacggctgctggactgttggtccggcggccgttttgtgatcaggaaattccaaaaaactggctctacactaaatcctgttgatgggctaccatgatggtaatttattgacaggatttttagctttgtggttacaaaaaaagggtaccttaaaggcacccgaaccggttcgttggctagaaaagcaccaactgcacacggtgtgtttgtactgtcctcgtattgtaccgctttataaaggctttccccttctctatctaaaaataagtagtatactagaacggttaagaattcggccagcaatatttaaaatgaggagcgatttttttggataagcggatttacattgataacgccggcaccaccaagacggccccggaggtcattgaaacgatgaccgaagcgctggagacgacttgggggaacgcctcgacgaccaactactacgggcgtcaggctaaacagatgctggaagattcacgccacctcctggcccggtcgattaacgcccagttcgacgatgaaattgtgatcaccagtggcggcaccgaaagtgataacacggtcgtcaagcaggtggccaaggcccgccaaagtgaggggcgccacattattacgaccgcctttgaacacgaggcgatcttgcggcccctagaagacttggaacaagagggctttgaggtgacctacctgcccgtcgacgagcggggccagattagcttagccgacttgaaggccgccttgcgcgaggacacgattctagtcacgatcatgaccgtcaacaatgaggtcggcagccacttgccaatccacgaaattggccaaattgtcgccgattccaacgcctggttccacaccgacgccgttcaagcatacgggaccttgccgttggacgtccaaacggaccagatcgacttgatgtcggtatccggccacaagctcaacggcccaaagatggttggtttcttgtaccggcgccgcgggatcgtcttcccgtcctttgtgcgcggcggcgaccaggagttaaagcgccgggccgggaccgaaaacgtaccagcggtggtcggctttgcccgggctgtcgaactgcaccaagagaagatggccgagcaccgcgcaacctacgtggccctaaagcaccagctggtggatgggttaaaagacgctgggatcgactttgaagtcaacgggagtttggatgaaggcgcagcgccccaagttttatcgctgtggtttaagggggtacctaacgacgccctcttaaccaacctcgacttggaagggatcatcggggccgccgggtcggcttgcacgtccgggtccctggatccttcccacgtgttagtggcgatgtttggcgccgagagtccgcgggtttgggaaaccctccgcttctcctttggcatttacaacacgccggcagaagtcgacgccttggtggccgccttggccaagtatgtccccctattaaaggacaagaccgatcgcggtcaacgttaaattaaaaataaattaaagacacgcttgtttttctcatttgggtttgctaacctaggtttacgagatgaggacgcaagctttcaccccggtgggcagattcgttctggcaccggggttttatgatggggggatgcgccatgcaacgacaagaaaagattgaactactaaaaagtctgatccggattgattcggacgacggcaacgaattggccgtcgccgaattactggccactgttttaataaatattggccggaatcccgtgactttagtcatgggatggataggcttctacttacgtcctttagggcgtttttttatttcattgtacttttgattattgatatattgctcaacgacctccttgctcatattccctaaagtactcatgtaatagctaggggaccagaggtggccaccccaatactgcgactggcggatttccgggtgtcgcttgaggaaaatgaaggcactgcgtcctttgagggctttgatagcgctagttggtgctttactaggtggaaaactaatcaacacatggacgtggtcaggcattacttccatgtgctcaatcacgatttctttatctgccgcaaccgttgtaaggatttctttcatttcattcactaacgcttcactagtaaaagttggattacgatacttggttacccaaatcaaatggtagtgaaagttataaatataacgccgtgtataaatggcatcttcgattttgtccttcgacatgattgccacgctccttaattattattgtcattgacatgtggtataataacactatatcagtgaaggaggcgaaaataaatgaagtcaatggcgcagatgaaatatcattacggactcaaggtgcggatttatccaagcgacaggcaaaagaaaattatcaagatcaatagtgatgctagtcgattcatctataacgaaatggttgcgatcaataaggaaccgatgcagcttcgcagagttaagctgccgattgacatagttcaggatcgtattaagcaactaactatgcgccaaaacgctaagcaaatgtctaatcactatcaattcttagaagataaacgaattgatagtttgacgaaagctaatgccattcagaactatcgaaaagcttggaatgcttttcggaaggttcacgccactggcgttcccaaatttcatcgaaagagttatcactggcggtatcaaaccaattgtcaatacccggggcaaaaaactgcgttgctaactaacggtacagtctgttttctagataatagtcatgtcaaagtacctaaaataggactgttacgtgttgccggttcgcaagcacggcttttgaaaagaatatgcgagactagaattggtaccgtgacgttgactaaagattcagcggatcgcttctttctctcaatgcagttagcgtcggatactccctttgtcaattggccgcaaaatacaggcaagcagattgggattgatcttaatactgaaaacttcttaactactagtaatggcgatactgtggctaatccacgctattaccgcataattaagggtcgcttagccaaagcacagcgcatcttatcgcgacgggctcgtcgggccaaacaagaacatcggccattacggactagtaagaactaccaaaagcaacgcttgttggtggctaaattacacgcccaagtctttgaacgtcgacgtgactttctccacaatgtctcgactacactaatcaagaaccacgatttcgtagccgcagaggaattgcggagtaaaaatatgctgaagaatcatgctttagcgatgagtattgcggacgtaggttggcggactttcttaggaatgttggcttataaagcagaactctaccatcgccaattccttacggtgaatcctaagaacactacgcaggcttgccatgaatgtggttttgtgatgggtacagtagggacagagaaactcacacttgcagaccgagaatggacatgcccaaagtgccatgctcaccacgttcgtgaccataacgctgcgcagaatattctaactaaaggaattattaaattagcctaatttggctcgtccctatggcaacctggggacgctaaaggcattggtaattgccgtgtaagacgaaacggttcgtagaactgttcgcagtggtgtatctatgcaaattgtgattcaaacactcatcagaagggtgcttgctcacaagccactgactttagtcagtggtggttgacattaagtaatggtgagacgctagtgggtgataattaatggtgcaagcgttctaattaatgatataatgttaatcggtagcaatatgttacatatttaagctaccgcttacgaaataaagccccggtgtgattacggaagtcacaccggggctcctctgttgcgattagtggtgaattaagtgccataaatgaagggcggtgccgttttcactcaaaatcaggatccctaagccaaggtagatcaccccggctaacagggtcccgtagcggtccaggagtgcccggacggccggtaggtgggtgatgatggtggccaagaggcaaaagacggcgaccatgacggcaaaggtgacaagcacgattaccagttcgggggaggtgcgggtggcgaagtaggggatgtagacccccaggttgtcggcaccacaggaggcgaccgtgataaaggtgacggtcaaaaagaggtggttggcggaaacccggttggcgggggtggccatgctttcttggtgggtcaacaggtggcacccaatggctaaggggaccaggcccaagaagccgagtatccactggtcaggggcccggcgtaaaatcaaagcggcgaccagggcgagcccgactaaaatgccggtgccggcgtagtcagcgcagatgatcgctagccgctggcggggcgtccggtagcggtgaaacaagattaacagcaccattaggtagtccatcccggtcgagatgaaggtgaggatgctagtaatgaccgttgccatggcggtcacctaaaagatggccaggccaatgaagaagagcagcggcacaaagagggccggcagcatgtcgatgctcttaaactcgcggatcttgagcaaggaaaaggaggccgccacgatcaagaggccgccgacgatcgacatttcggtgatcaaagccggcgagaaaaaggaggccgacaaaaacttggcgaccaagtagatggcggtaaaccagatgaagagcaccggtacttcgaggatcatccccagcccaaagccggccccaaagacgatcgcgcagaccagggtcagcatggcgttggtgtacaagaaggtttggttgccagtggtggcggcgttaaccggcccgaggatcgccagggcgccgatgcaatccaggaaactggcggtcgccaccgcttcccctagtgcggtgtggaaggtccggtcgatccaagcgttggcccggtcgtcgagcttgagccaggtcccgaccggcagcccgatcgctagcgaaatgataaacaggaccgggtagtggctcttgggcaggttggcgacgacggtttgcgccccgaccccgagggcggccagccccaaagcggtccagaaggtggccacgtacttgtcggtcagcacctttttaaagacccagccgatcacggtcccgacgattattgcggcgacgttggcccaaattccaatcataattcattcctcgtttctaatgttctaacttgtccattatacatggattgaccgggctttgcttaatggtcgcaacgccctgaccaattggggtggtggtgagcaagttggcgggcaaaactaactaaacgtggtaaccttaggggcaaggacaagcagaaaggatctgatcagatgacggcagaacttaagacggcgacctttgccggcgggtgtttttggtgcatggtccaaccctttgacacctacccgggaatcgaaagggtcgtgtccggctacaccggcggccacgtggctaacccgacctacgagcaggtctgcgccgggggaactgggcacaccgaggcggtccaaattacctacgaccccagtaaggtttcctacgccgatttggtagagatttattggcaacagaccgacccgaccgacgcctttggccagttccaggaccgcggcgacaactaccggccggtgatttattaccaaaccgaagaagaaaaggggatcgccgaagcttcgaagcaaaaactccaggacagcgggcgctttgaccaaccgatcgtcaccacgattgaaccggcccaaccattctatccggccgaagaataccaccaggacttctataaaaaggatcccttccggatgatgatcgaagaagccggcggccgccagaagtttatcgatcagcactggaaaggagtgagtggcaaataacctcctcggcaggtcgtatcgactaagctaggacgaatggttgatgcggtacgcatcgttcttcgtccgtacttagacactagacctgcggttatttgccacgttatctgtctaatattcgggaaaacaacgagcagctgggtaaagcagaattttcccagtctcgattgttagccatccataacttattaaatttcagcttgacaggttaggctgggttcagtatgatacctttaaaatcaaattaaagaaaagttagaaagatgagtaaaccgggaggggtgcccagagagtcagcgcttggtgaaagctgaactccctgaacggttgaagatggtctttgtgcaatgccggggtgagccagtggtgagccccgaccgggttaacgcccgttatcaccgttacggcttgttggagccggttgagggtccccgcggggaccgaaaatgggtggtaacacgttgatcaacgtcccatgaggtagtaatgcctcatgggacgttttcttttggacttttcgaggaggatatcttatgcaaaaacgttatcgcaaatggttgtggctagtcttagccctgttagtcgtgctcggggggattggcggcttagtgcaccagcgcctggccagcactagtcacaagacggtcaaggttggcctggtggggaccgactcactgccggtttggaagaacgtggccagccggttgaaaaaagacgggatcacccttaagtttgtgatctttaacgactacgtccaaccagacgtcgccctaaaggatggcaagatcgatctgcactcctgcctgacccgctactactttgagtcctacaacaagaaggaaaacgcccacctggtatcgattgggaacaccgtgatctcaccgctgggcctgtactccaagaattacaagtcgattaaggacttaccagacggggcgacgattgcgattccaaacgagccaaccaccctcgggcgcgggctcaacctcttgcaatcggcgggcttaatcaaggtcaaaaaagacagcggcatcaagccgtcgttaaacgacatcacttccaacccgcacaactttaagtttaaagaggtcgacccagccacggcggcccgggctttggattcggtcgacgcttcgatcatcaacgggaactacgccgaagcggctaacctaaccccgaagaaggatgcgatttacctggaaccggtcaacaagtcaaccaagccgtacgttaacatcatcgcgacccaggaaaagaacaaggataacgccacctacaagaagatcgtggcggcctaccaaaccgaggccactaagaaggtcatcgataagacttacaagggttcgcaaatcgcggcctggccacaattcggtaagaactaaggaggaagaaacatggcgagtgaaacagcaatttttgccggcgggtgcttttggtgcatggtccaacccttcgacacctacccgggaattaaaaaggtcgaatcgggctacaccggcggccacgtggttaaccccacttacgagcaggttaaggccgggggaaccgggcacaccgaggcggtccggatcacctttgaccccagcgtggtttcttatgcggacctggtggaaatctactggcaacaaaccgacccgaccgacgcctttggccagttccaagaccgcggcgataactaccggccggtgatcttcgtcaaggatgaagaacagcgcgccatcgcccaggcctccaaggatgccctagccaacagcggccgcttcactgacccgatcgtgaccacgattgaagacgcaaagcccttctacgtggccgagaattaccaccaggacttttacaagaaggacccggaacggatgaagctagagaaggctggtgggcgtaagcagtttattgaggataattggaaaaagtgagtgcgacccaaccataaagaaggctgtggggtaaggatagagcacgggttagcgccctcgacggtgttctgtggccagacttagccactaggcctacggctggggagtacgttatgggtgagtgcgaccaaccttctcgacgggtggtatgtaagttcaatatctagaaagtagaaagcagctcgctagtcggatgacgattggtgggctgttttttaggtgggaaccaaccttttggaagcgaacgaatgtcaaaattaggtaaaatagaagggtagtggagctagggctcgcgaccttggtgaagctacagcgttccggaagtgactccctgactccggaaaggggatgatctgaatggaagaaaagtatgccggaaagcgaggcggcggattatcgctctgacaatcttgatattgtcggtagctgcggtcaacttggccaaagcgtacgcgagagaaaggtgagtgtgatccaacctccgatacagaccgtatggctaagctagggcgggggttagtgcggaacgcactgttctccgtccgtacttagacactaggtctgtggttgggagcacgttatctgagtaatcgtcagcaataaaaaaagctaatcgcaagtagcgactagctagcagtcttaaattccggaacgcaaagggacgagcggataaagtgacacaccgcttgtccttttgcatttctagtgtaccacaccgccaaaatttggtcgatggttttgtaaggagaatcaaaaggacgccagcgtggttttggataaccggctgacgcccttattttaattaatattagccggaaatcccgtgactttagtcatgggatggataggccactattgagcacctttatggggctttttgtttgtttctgtatatttttggtcattgatatatttctcgacaacttctttgctcatattgcccaatgtactcatatagtaactcggcgaccaaagatgaccgccccaatattggctacatcgtatttctggatgattctgtaaaaaaatataggcactacgtcctttgagcgccttaatggcactagccggagctttgcttggcggaaaactgatcagcatatgaatgtaatccggcatgacttccatcttttcgattacgatgtcattgtcatctgcaacttgctgcaagatagctttcatttcgttagctaagacctcggttgtaaaagtctgattgcgatacttagttacccagatcaaatgataatggaaattatagatataacgacgagtataaatggcatctctgattttttctttagtcataatatgctctcctttgttaatacattgacatcatgatataatgttattatatcaataaaggaggtgaaatcaaatgaagccaatggcaaaaatgaaatatcattatggcctaaaaatgcgctgctatcctagtgaccaacaaaagcagttgattaaaatcaatagtgacgctagtcgctttatctataacgaaatggttgcgatcaataaggaactgatgcagcttcgcagagttaagctaccgattgacatagttcaggatcgtattaagcaactaactatgcgccaaaacgctaagcaaatgtctaatcactatcaattcttagaagataaacgaattgatagtttgacgaaagctaatgctattcagaactatcgaaaagcttggaatgcttttcggaaggttcacgccactggtgttcccaaatttcatcgaaagagttatcactggcggtatcaaaccaattgtcaatacccggggcaaaaaactgcgttgctaactaacggtacagtctgttttctagataatagtcatgtcaaagtacctaaaataggactgttacgtgttgccggttcgcaagcacggcttttgaaaagaatatgcgagactagaattggtaccgtgacgttgactaaagattcagcggatcgcttctttttatcaatgcagttagcttcagatgaatcttttgttaaagtgtccaaagctactcatggacatgttggaattgatcttaataccgataacttcttaaccgacagtgaaggcaacatagttcctaatccacgatattaccgcactattaaaggcaaattagccaaagaacagcgcattttatctagacggcaacaacgtgcaaaaaaagaacatcgttctttacgagatagtaaaaattatcaaaaacagcgcttgttaatcgctaaactccatgccaaggtaatgaaccaaaggcataattttctccaacaaatttctaccgcattaatcaagaaccacgatttagtagtagccgaggagttgcgtagcaagaatttgcttaaaaatcatgctttagcacttagtatttctgacgttggctggcgaatatttcttggcatgttggcttataaagcaaagctttatgggcgtcaatttatcacaatcaacccaagaaatactacccaaacatgtcgcgattgtggctttgtaatgggcactaatgggacggacaaactaacattagatgatagaaactggacttgtcctaactgtggtattcaccatattcgtgactggaacgcagctaaaaacattcttgataagggaatagctaaactagcctagcttatctgtccctatggcaacctggggacataaaaggcgttggtaattagacgaccgctgtttgattacaatttcagttggtcaaataagttgtccctatctacgcaaattgtggttcgaaatccgtgatgatattcggctcacaagccactgactttagtcagtggtggttgactgaaggagtattttgagagaattagtgacgcgctttagcgaccgtttcttgatcgaggtagtgaagggagaagggctggtcagttaaaaagtagcagtgacagtcttgttcgggactggcaccgtggcgcatgatttgccctttgggtccgcaaacaaagtttcccgggccaaagtagagttcggtttggtcaaactggctttcgttgacgaagatcccatctaagacaaaggcggcgtgggtgaagctgtggtcgtgccactcggtaatgtgatctgcggggtaatcgagtaacatgacgcaaccaccaatttggtccggcgtcagcaggttcttcaagtagaggtgaacgtgaccgtcctcttcgtagggcagccaaggctggtcatcgttagcaaccaagaagtggtgccgctagcatggtgggggcctggtggaccatgagcagggcgtggagggcctcttgaccgtccaccgtcagggtcgtcgtttgtccggccggaacgaccagcgtttggtcggggccggcaacttggtcattaaagaagaggtggccggccaacacaatcaggatcaggttctggctggtgtcatcccaggtaaaactggttgccgccgggatcaccacttcgtcaacttgcatgtcgatgttttgctagtgaacgtattcggcgtagtaggcttccgttccgatcaggtggggcgccttctttagagggagtttgcccgaagttagggtgtgaagtagttcattagccatggcgatcacctacatcttgacaaccggcttgaggaccttgccggccttgaagtcgtccatggcttggttgagatccttgaagtcgtaaaccttgatcattttgtcaaaggcgaagcgcccctctcggtagtacttgatcatttccgggatgaacttttgcggaatcgcatccccttcgaccaggccggcgatcttcttggattcggccaccaagtcggtcatcatgttgagcttgaggtcgcccccaattccaaccaggacggcttccccggccgggcggaggatgtgaacggcggtttcggcgacggcgggtactccggtcgtgtcgaggctaaagtcgaccccacccggttcaatgtctttgattacttcttcggggtcaacctggaggctgttgtagcagtcggtggcgccgaattccttggcgaaggccagcttggtgtccttgcggtcaaagacgatgatccgcttggccccggcaaccttggcgcccaagacggcggccaggccgaccggacccatgccgaagatggcgatcgtgtcgtccttacttggctgcatgtagttgaggacggtgccggccccggtctggatcccacagccgagcggaccgaggatggtcaggtcaacgtcgtcgggcaccttgacaacgttgtgctcgtcggcgacggcgtaagtcgcaaaactggactgcccgaagtaaaggttcaggtcgccgtgggcggagtggaggcggtggctaccatcaaagttggggccaaagaagttaagttcgttaaacttctcacacatccctgggcggccagctaagcagttgcggcactgaccacagtaggaaaaggagaggatgacgtggtcacccggtttaacggatgaaacggcggcgcccacctgttcaacgatgccggcgccttcgtggccaaagacggcttcaaagggggtggtgagcccttcttggcccgccacgtcggtgtgacaaaccccggtcgccacgattttgatcagaacttcgttgtccttgggggcatcgagttcaacttcttgcatctcaaaggcttggtttttcgccggtgctacggcagcggtaattttcatgagttttcctcctcaggaattagattgtaaattaaatcacaagttaaagtttagcataagtaattccaaagggagccgggttaacttactccccacccgaagtgtataattcgggtaaaaggaggaagcaagatgaacgtcgatcaaatgcgcctgttcttggaggttgttagcctgggtagtttccagcaggccgccgagcacaattacatcagccaacgggcggtttcccaacagatgaaaaagctcgaggaccaactaggggcgccgctctttatccgcgaacataaccacatccgcctgacggccgccggcgagtacttccgtcagcgttgcgaaacgatcgtcactatgatcgaggacatgaccggcaaggttaaaaacctcaagttcgccaccagcaagaaactccacgccggctacttttcgccctttgacgccatgctcttgcgcgaccaattactgaagttaccccaggacaccaacttcaccctgaccgaggagggggtcgaacatctggtgaccgacgtcttgttaggcaacctcgactgcgcgatggtgatggacgattacggcttccaacaggacttcgcccgcctgggactggccaccaccaccctgcacgaggacacgatggtgattggggtgggggaccgcctcaacctagcggacaaggtctggttaaaagacatccaagacctaccggtgctttattacagctccgagaactcgacctacctgaaggaatcctttttggccagcctcgatcacgggatgcggaccttcgacgtccagcgggcccattcctacgagcagatgcaaatgctggttagtatgggggaagcgatcgccttttacccgcagaagttaattgcccgcctcgccaatccgaccgaaccgattcgctacctgatcccggaggactatcaggctcgccacttcaccttcaagttgatgtataaccagaccaacccaaatgagagtttgaaggagttgttgaagcaggttaaaagaagtggcaactgaaaaatgagactggggaaagcaatgtttctccagtctcattttatttccaacggatgcacaaccacctgggccttattaacttcttagcccacggcctgcttgatggttgggtcgtactcacaagataacgtgctcccaaccacgggcctagtatctaagtacgggcgaagaacggtgccaaggcaccaatccccgccctagcttagctatacggcccgtcgaggaggttgggtcgcactcacatctttacaatcggcttaaataccttaccagccttaaagtcggcgaaggcctggttaatatcctggaagtcgtaaaccttgatcagcttgtcgagcgggaacttgccgtcttggtagtacttgatcagtttcgggatgtattcttgcggaattgaatcaccctcaacgaccccgacgagcttcttggattcggccagcaggtcgttcatgacgttgatttggatgtcgccgccgatcccgatcaaaacacaggttccggccgggcggagaatgtggatggcgtttttgatcacgaacccgttctcggttgtgtctagggagtagtcgatcccgcccggaattagttccttgaccgtagcttccacgtcgatatccttgccgttgaagacatcggtggcgcccagctctttcgccatggcgaggcgttggtcattgaggtcaaagaccaggatccggctggcttcggcgatcttagcccccatgacggccgacagccccacgggacccatcccgaagatggcgatcgtcgccccgggttcgggtttgaggtagttgagcaccgatcccgacccgttttggagcccgcagcccagcggtcctaggtaggcgaggtccacgtcggcgtcgtcgggcaccttcacgatgttgtgttcgtcaaccaccgtgtaggtcgcaaaacttgattggccaaagaacaggctcaggtcgtggcggtccttgtgcatccggtgggtcccgtcgaagtttggcccggcaaagttaaggtcgttgaacttctcacacatccccgggtgaccctctaagcagttgcggcacttgccacagtaagaaaaggaaaggattaccttgtcgcccggttgaacggatgacacggcagcgcccacctgttcaacgataccggtgccttcatggcccaagacgactggcatcggggtggaaagcccatcttggccagcaacgtcagtgtggcagacaccggtagcaactagtttaattaaaacttcgttgtccttaggagcatctaattcaatttcttcgagctcaaagtcacgcttttcgtcattcacaaccgcagcagtcactttcatataaaggcctcctttttggtagcgattacatttctctgtaatatcattataacatgtgaaatttagttagtgaccgttgcaaaacaaggggtgccgaatcacaaacttcggataagcagtcaaagtgactaacgaaacgaatgagaatgactaattatatgataagtgatcgataagcgtttatcatcggataaaaacgagtttagtcagtgacggcgtagaccattagttggtgcattattgaaaattagaatataataacatataaattaaaaataattggtgacgtaactatcgaataagaaaatagccaattttatcaatcattatcaaagtgcttgtattttgaccaatccgtcctaaaatgagaatacgattaaaattagtctaatttaaaacgaacggaaccaatcaggcaaggtggattgagaaatgattgatcgaacaaaaaccatgtacacgcctaactacgagcacgatgcctgtgggatgggctttattacccaggtggacggccagaccagccaccaactcgttgaacgcgcgctgacgatgctcaagcggatgaaccaccgtggcgggaccggggccgaaccagataccggtgacggggccgggatcctgctgtcgatgccggacgccttcttccaggcctacgctaaggaagcggggctcaaagacttccccaagaagggtgattacgccgtcgcaatgctctttgtcccccaagaagccgacgaaaagcaggcgatgctaaagtccgttaacggggagatccgccgggccggttaccagatcttaggcacccgcgacgtgccctacgtctacgaaaactgcggtccgaccgcccaaaaggcgatgccaggcttcgtccaggtgttaatcaagcgtccggccgacgtgcaggcggggcgcccctttgaagacgcactgtatcacctacgccgcactttagaaaagaccttctcggccgccgaatttgccatcgttagcctctccagccggaccctgtgttacaagggaatgctgcacgcctaccaggtttccgagttttacccggacctgcacgaagaaacgatgaaagcttcgatcgctttgatccactcccgcttttcgaccaacaccttcccgagctgggagcgggcccaaccgttccgcttcatcgcccacaacggggaaattaacaccctgaagcgggccgaaaactggatggtctcccacaagattgaaatctataacgaggacgactccgattcggctaagctggaaaactgcatggagtacctctaccgtcacggtcgcgatatcccgcagattttgatgatgctgattccggaagcttggagcccggccatgcaccagccagccgcccaggccgccttcgatgaatacaacagctgctttgtcgccccgtgggatgggccggccgccctgtgctttaccaacggggttcaggtcggcgcctttttggaccgcaacggcttgcggccgtcgcgctacgtcctcgataaggataacgtcttggtggcggcgtctgaaacgggggtctacgacgtgaacccggccgacgtagttgaaaagggggtcctcggcccggctgaaatgctcttggtcgacaccagtgagggccggatttatcacaaccaggaattaaagcaacgctacgcccatcaacatccctaccaagagtggctacaagaagagcagctgacgattgacgacctgccggaagccgacgtggttgagcacctgtccgaacacgctttgcagaccctctggcggcgccacggttacaccgaggacattattcaagacgccattattccgatggccacggcggggggcgaaccggtcttttcgatgggctttgactcgcccttagcggtcctaagcgagcagccccaatcgctgtttacttacttcaagcaacagtttgcccaggtgaccaacccgccgattgatgcgatcagggaggacctggtgatcggcaccgagatgtatttgggtagcgatggcgacatcacccaggacgtgccggccaacgccaagaagatcaagttagcctcgccgctcctgtcgtcaaccgactttgaaaagatccgccacctgactggcaagcggggctttaaggcggcgatggtttcgctgtgctatggtaaccaaccacgcccgcaccgcctcgagcaggccttagacgacctctttaaggacgccgaagaacaaatcgatcgcggcgccaacatcgttattttaagcgaccgggggtccactagcgacgacctaatcatcccggtcctcttagccgtggccggtttaaacaactacctagttcgcaagggcaagcgggagttagcctcaatcatcgttgataccggggaggcctgcgaaacccaccactacgccactttgctcggttacggcgcctcggcaattcacccgtacggggtttacgccaccctgaattacaaccacttggcggaccgggtcgacacctaccgccgggcggccttaaacgggatcatcaagatcatgagccggatggggatttcgacgatcattggctaccagggggcacagctctttgaagcggttgggatcgccaaggaagtcgtggaccgctacttcaccgggaccgaaagccggatcggcgggctaaacctcgaccaaattgaggccgagtacctggcccgctacgaccgcgcctttggcagccgcgccaaggacgccctcccgtccggggggagctataagtaccgggcggatggcgaacaccacttgtacaacccaatgacgatgtacaagttccagcaggccgtccgcttgggcgactatggtctctaccaggagtacgctaagttgatgcaccaagaggaacaagccaccccgacgaccttacgggcgatgtggaacgttcgccccaatcgcgagccggttccgctcagcgaggtcgaaccggttagccaactggtcaagcgcttcaaatccggggcgatgagttttggttctctttctaaggaggcccacgaatgcattgcccaggcgatgaacgagttgggcgccaagtcgaactccggtgaggggggcgaaaacagccaacgcttcaagccgcaaaaggacgggcgcaacgtcaacagcaagatcaagcaggtcgcttcggcccgctttggggtcaacgccgcctacctgatgagcgccgaggagatccaaatcaaggtcgcccagggggccaagcctggcgaagggggccagctaccggggaacaagaacttcccgtgggtcgccgagatccggggctccgtgccgggggtccgcctgatttcgccgccgccgcaccacgacatttactcgattgaggacttgaagcagttgatctacgacttaaagcaggttaacccctttgccaagattaacgttaagctggtgtccagcaccggggttggcacgattgcgactggggtggtgaagtgtggcgccgataaggtcgtcatttccggttacgatggtgggaccggggcggccccgcggacttcgatcagggacgccggcctgccgtgggaaatgggcctagccgaggctcaccaaaccctgaccttaaacaacttgcgccaacggacggtgattgaaaccgacgggaagttgatgactggccgcgacattgcgatcgccatcatgttgggggccgaagagttcagctttgcctccctggtgttagtttcaattggttgcatcatgatgcgggtttgttccaagaacacctgcccaaccgggatcgccacccaaaacccggcgctgcgcaagttcttcatcggcaagcctgaatacgttaagaactgcatgcgctttttggccgaggacctgcgtcaggaaatggctaagctcggcttccggaccgtcgacgaactggtcggacacaccgaactgattcacccccgctacgtcgccaagggcaaagccaagtcgctggacttctcgcggctcttggggacgtcagttggcattcaacgcaagccagtcgaccgcttttcacccaagcataagtggccggacctcaacagctttgccgaggcagcggtggcggccaagcaagacttcgtgatgaaggaagcgattaacaacgagcaccgggcggccggggctcggctggggggctggttggcgagccgctacggtaaccatggcgttgccgctggtcacctccactttgactaccgcggggtggccggccaaagtttcggcgcctttatcacccagggcctcgagctcaagttgaccggtgaggctaatgactacgtcggtaaggggctcagcgggggccgcttgattgtggcggccccaccagaggctaagcaactctacagccagtcgccaatcgtcggtaacgtcgcttgtttcggtgccacgtctggcgaggcctacttcaatgggctggccggcgaacggttctgcgttcgtaattccggcgccaaggtggtggccgagggaattggtgaccacgggtgcgagtacatgaccgccggggtggcggtgatccttgggccgaccggccataatttcggcgccgggatgtccggggggatcgcctacgtttacgatcccgaccacaccttcaaggaacggtgtaacctggaaatgattgacctcttcaagctcaacgagaagggtgacgacggtcaattaaaaccactgatcgaagcccacctccgttacactggctcgctaaaggccaaggcaatcctagccaactggggccaggaagcggctaacttcgtcaaggtttacccaaaggacttccgcgccatcaacgaggcgatcgccgccctcaaaaagcaggggaccccggccgaccagctggaagaaaaggcctttgaggagctggttggggcggccccgaccatcgccaagtagggaaggaggaactattatgtcagacccatttggttttatgaaatacccccgcgtcaacaatccctaccggccagtcaaagagcgggtcaaggacttcgccgagttgcaacatgttttatccgacgaagaacggcgcaagcaggcggcccgctgcatgaactgcggggtgccccactgccacgttggcttcttttattccggcggcaaggcggtcagtggctgccccaacgacaacctgatcccggagtggaacgacatggtctcccaagcaaaggaccgggcggccttcgagcggttgaccaagaccaattacctgccggacttcaccggtcgggtgtgcccggcgccctgcgaagtcgcctgtaacgaggccctgcacggcaaggggatcacgatcaaggacaacgaacgcttcatcattgaccagggctttaagtacggctgggtcaaggaaagtggcctgccggttaagcgtaacgggatcaagatcgctatcgtcggctccgggccaaccgggctctcctgtgcctggcggcttaaccgcttgggctatgacgtgacggtctttgaaaaggacgaccagcccggcggctttgccatgtacgggatcccgaacatgaagttgcctaagggaatcgtctttcgccggattgaggtgatgaaagaaatcggcatcaagttcgtggtcaatacgacggtcggcgtcgacgtcacggcggcggaactaaagcagcactaccagcggattgtgttggcgatcggtgcccgcagcgcccgcgacctcgacgtcaaggggcgccaactcaaggggatctaccaggccgtcgacttcttgacgctagcgactaagaaggtggtcaaggacggcaccaaggcgacgaaggttctggccggcaagaaggtcctcgttattggtggtggggatactggtaacgactgcatcgccaccgccgtccggatgggggccaaggatgtccgccagttggaaatcaaccggcgcccaccaacctaccgcctgcccaataacccttggccggagtggccgctgaccgcccggaccggttatggccaagaggaagccaaggaactctttggcggcgtgatcaccgactacgagatgacggcggtcggcttcaccgggcaaaacggcctggtcaagtcggtcaccaccagtaaggcccgcttccataagccggtaccggggaccgaacaggagcaagacgttgacgtcgtgatcctggcgatgggctttaacggcgccgagcaaaagtacctccaggcctttggggtcgaccaggttaacgaagattacaccactaacgatgagcaggtatttgtggccggggatgcccgccgcggacccagcctggtcatctggggaatctacgagggccggatggtcgccgaacaggtcgatgcggcgtgccaggtaagggtataaaaggaagtgtgactaaccttctcgacgggccgtatagctaagctagggcgggggttagtgcggaacgcactgttctccgtccgtacttagctactaggcccgtggttaggaacacgttatgagtgagtgcgactcaaccattgggcaggccgtgggctaaggactagacacaggttagcgcggaacgcggtgttctgtggctggacttagccactaggcctgcggttgaggaacacgttatgaggaagtgtgactaacctcctcgacaggcgttaccttgaaaataaaaagcagcccgctattcggatgacgactggtgggctgtttttggggctcttacacctatcgaacttaaccttccaaagcgtcgacgccaccatgcaacaagtcttttacgcccttatcttagggctcgccttatccttcattcgcattctgaccaacgggttatgggtcgggatcttgcttcactccttgatcgactttcagccgacgattgcgaccgggggctccgcggccactaactgggggtccttgctattgatcttcttgccgctgtttgtgatcagtttgctctggctgtggtttgccgatcggttattgcttaaaaagaagggtgagacaccgttttcataaaaaaagcgcccggaagaaaaacgaacagaaagcgggaaatgatccattttcgttccggttcaatgttataatgtagccactagaaaggaatggtgattgaggtgtcaagtcaagaatggtttcaaaagattgcccacttgctcgaactggtagcgttagtggccgtcgggctcctggggttggcgttgatcgtccaactggggatggaattattggcggtcgtcaagttggcgctcgccccggtttccgaccccggcttttacgacttcttgaacgaagtgacctcctttttcatcatcttcgagttcatcgtgatggtgatcgaagccctgcgcaaccacggccacatctcaattacgatgctgatggggctggggttaaccgccctcttgcggcacctcttggccgctagcaactccaacggcatcgaaacgatggtcgaagtggtggcgatcgtcttgctgacggtgggactggcgatttaccgccgctttgtccacgatccagacgagaattttgagaagagaatttgatccggaggcttaatatgacacaatacgttcaagctttaaccatcgccgggcacgattccgacggcagtgccgggatgccggccgacctgcacgcattctttatcgacggggtttacggccaggggctgctgaccgccgccgtgtcggggaattcctacgggatcacccagcaacaaatcatgccgaccagcttcattaaggaacagtttaaggtcctcgccgacgactttgccatcaaggcggccaagaccgggatgttagccaacgatgacgtgatcaacgccgtcgccgattcttatgacgaagccaagttcggcccgctggtggtcgacccggtcatcatcaccaagcatggggtgatgctcctggaacaatcggcctacgagctcttccgcgagcggattatcccgctggccaccgtcatcacgcccaacttctacgaggcccaaaagctgaccgagttggaattaaaggatgacgatcaggtccaagaagcggccgccaaactccacgccctgggcgccaagaacgtcgtcattaagggccaacacatcgaggggcaaacgaccccggtccgcgacttcgtgtcactagcggacggtaagaccttctggctggaagaagagtacgtacccaccgaccgggtcaacgggaccggcgacaccttctcggcgattatcgccgccgaactggccaagggacactcggttgaagccggggtgcgcctggccaagaaggtcgtccacgaggcgatcgccaacgaaattgaggtcggccaccagtttggcccgatcaaccactgggcctgtcaagaagcggccaactaaccaaagctaatgaataaaggctcccagtcgttcaccagaacggccgggagccttttgctgtttaatacagttccaaaatcttcttcacggtgccggcgacgtcatctgcccccagtaccatcgagatcatcgacaacccggcgcagccactggtcaaagtggcgccgacgttgtccaggctaatgccgccgatcgcgacgaccgggtgggcggattgttcaacgaagtcggcgagaccgtccacacccagggcgctgccggcgtcgtccttagaaatcgtcgggaagaccgggccggtgccgatgtaatcgacgttcagctggttggcgtgggcgacttgggccgccgtgttgcaggagtagccgaccattagctggtcactgaccgcggctaagacctcttcgatccgctggtccttttggccgacgtggatgccgtctgccttgatggcggccgccagctctaggtcgtcgtcgacaaagagcggcacgccgtacttggtcgccagctcccggacttgctgacccagcgccagggtttccgcctttgaaagggtgctggtccctttttcgcggtactgaaaggcggtgatcccggcttgcatcgctgcttcgaccttggtcaaaaactcatccgggtcgtggtgggtgtcttggctgccgccgatcaggtagcagcgcagcattccatttttaaataacatggcttttctccctagctattggctagttttcaaatgttagacagaaaacgtggcaaataaccgtagccctagtgcctaagtacgaccgcagaacggtgcgtaagcgcaccaacctccggtctagcttagtcatacggcctgctggttaggttatttgccactctctataatgcccagtgattcagtgggccgtggccgtggccaacctggatcgtgtcgcgaatcgtcgcttctacgtaccccttagcggtccggatcgcctgttctaacccgacgcccttggctagttcggccgtgatgcaggccgaaatcgtgtcgccggtcccgtgagttcgaacggtgtcgatccgtggcgaggtcatccaaaagctggtgccatcctccatcaagacgaagtcgctggccgcttggtcgccgccgaggtggccacccttgaccaggacgtttttgggacccagcttttgcagggcctggccgattttaaccatatcagcggggcgctccgcctttaacccggttagggcctcggcttctggcaggttgggggtgaccaaggtcgccagcggcaagagttcctctttgacggtggtaatcgcctcgtcggccaatagcttggcgccgcccttagctatcatgaccgggtcgacggtcagggggccaaagtcgtactgctttaagttgcgcacgaccgcctgaacggtgggtacgtcggccagcatgcccgttttagccgcccgaatcttgaagtcgtcagccaaagaggcgagctgggcgtcgatcatttcagtcggcaaagcgagggcgtcctggacaccgagggtattttgggcggtcaccgccaccaccaccgtcgtcgcgaagacgtggcgcatctgaatcgtctttaggtcggcttgcatgccggcgccacccccggaatcggagccggcgatcgtcagggcctggggaaattcgttagtcattttaagcttcctttccaaatgcttattgccaagcggcgagctgctgatcggtgacggcgtcgaggttgtttaacagtcccgggtaccagttgcccggccgctggtcttcgacggcttggccgcagagggtgaaggtggtcacggcgtcaacggccgcgtcaaaggcgtcgtcgttagtggccaagaaggcgccgatcaaactcgaaagcatgtcgccggtcccgacgtgggtcttaaaggccggggaaccgtacggcaagcgggccaggcgggtgccgtcagtgacgatgtcgacttcgccggataagacgatcaccgagccgagctttttggccgccagccgggccaccttctcgaggtcggcgttgccctcgccggcgtcaatcccgtggctttgccattcgaccccggctaaggtggcgatttcaccggcgttgccgcggatgacggtgaagtggtactggtggagcagttcggtgaccacccggagccggtacatggtggcgccgcaagcgaccgggtccaagacggtcggcttgtggtacttcttggccgcttccattaccgcctccatttcgccgcgctggtgggggttgagcgtccccaggttgatggcggcggcttgggcgatgttgaccatgtcgtcggcttcctccggcgtttgcgacatcatcggcgaggcgcccagggcgttgaggccgttggcgacgtcggcgggggtaacgttgttggcgacggtcaagacgatcgggttggttcccttgatggttgcgattgcgttttgcatgtttttctccttaatttaagtgagtggtcaccaaccaatttagcaggccgtatgactaagctagggaaaatggttagcgccttggcggtgttctttgcccgtacttagacactaggcctgcggttggtgagcacgttagcggcaaaagaaaaggccaccggggggaatcccggtggcctatttcgccgaccgttgcttccctccgcgagtccaaactcccaggttcaaagggtccgccaattggcgtctcagtcggtggtccgacacccctagcaactattacccctccattatagcggggatcagtcagaaaacatagtgcattcttaactttgaactaagttataattatttatggtcaaagcatgcgctgcacccttataatattgctgaaaattgaaagtggagttgataaaatgcacaagcgattgatgacgaaaccggtgtgggaccggtgaccggggcccggcgagtgagtcgcgggctggcctggatcctggttgcctgcctagtggggggcctggtgtctaactttaccttctcgcaaaactgggtcacctccctaatcttggtgccgctaaccctactgggctggtggggcctgcctaagctagcccccgtaattgaccggttgaccaaccgccaagtcaccctgctcgttggggtcggcatgacggtaatggtgctcttgcagatggcggtcttaaagtggttgccagtgacggtttaccacgacccgctccgggtcctcgaccaggcgacccggatggcggtcggccacaccagctggaagattacctacttctggcgctacccgcaaaatgtgccgatcgcctacctcctgtcgcgctggctcaagctgacgatggaaatggggatgggcgtcaaccgcggcgtccacctcttgtcgatgctgatgctggacgggatggtcctgctcggcatcgacaccgcctggcgggtcagcaagaaaaagcacctcgtcttgggcatcttagccttcggggtcctgaccccctttgcctacacctactacctgcaggtcttttacaccgacctgccggtgatgttcgtcctcttgtatttgttgcggacgctggtcttgtggcggcgccgtaattggtggcaaaagagccttagtggggccctcttggtgctcctggccatgctgggacagttaaccaaggccaacatgatcgtgattatcccggcgatgctgttgacagccctgattttatgggggcgccaccgctttaaacaaagccaactactagtgccaatgctcttaattacgctcggcgtcgccctgtcctttccgctctccagcaccctggacaaggcggcccacttcacccgccagaccgactacgagttcccgctgacccagtggatggcgatggggcttaacgagaagagcaacggggtctacaacaccaaggacgccgtggccaacgtcaagctcaagaccaaggcggcccgcaacgcccacaacctccaggtgattaaacagcgcctggccaagcaaaacgtcggtttaatcaagctctggctagccaagctgatggtgctaaccaacgccggcaacatcttccactggtacaacggcgggatgcaagaggcaccgcggagctacctcaaggccgccccggtcttcaccgggctcgtggcaatttcctaccaactggcgacctgcctgttgtttggcttcgtgatcaagcggctcttggcgaccaagatgaccctggcctcggccaacggacaagttgccctgctggtgatcctaacggcgctgggctatttggccttccacgtcttgctgtgggaagtcgaagagcgctacggcgaggtgctggtgccgctgagctggctgttggtgaccctcctgccggccgctgacgaccaaccgatcacgcctaagcaagtcgggtccgtctttgccctcggcacggtggcggtcctggtcggggcgatgaccaacctcggcgttaactccagcggccaaaccgttacggtggccgcccaacgctcccagctatcgacccagtacggggccaagccggttgacctggcgccgggcaagcaaatcagccaggtcgtcaagatcaacggggcagccagtgacgtctccgtgcagatccacgccaagtcacacgttacggtgaccctggtagaactaaaaactggtgacgaatacgtctttaagcgccacgccgacgagtacgattaccaagggaacgtgccagccggtacctaccagttcgtgatcaagaaccaaaccgccgtggaccaagatgttgacatcgcccacgtcccgtactaccggatggcgccgtacccgatggacgaccagggaacggtccactgggacacgtcattgatctactggttccgtgacgttcgctccgccaattaaatagaattagaaaaccccagccgttcgggaaaccgagggctggggtttttgggtgggaagaggagaaaatttggaattaggagggatttttgggcgggcgacagaatatgtccgaggggtgggatactatggagttagtcggcaaacgtaaaaagaggtcgcgaaatattcgctgatccttcgttcaaatttatcaaaataactactgaaagcgattgcgtttgctataatctatcttgactacgatattaaggagtggattacgtgaaagagtatcacattggcttggacattgggacaagctcaattggctgggcggtaacggatagccaatttaaactgatgcgtatcaaggggaagacggcaatcggggtgcggttgtttgaagaagggaagacggctgcagaacgccgaaccttccggacaacgcggcggcggttgaagcggcgaaaatggcgcttgcactacttagatgaaatttttgccccgcacttacaagaagtggatgaaaatttcttacgccgtctgaagcaatcaaatatccacccggaagatccagcgaagaatcaagccttcattggtaagctcttatttccggatctactgaagaagaatgaacgtggttacccaacactgattaagatgcgcgatgaattgccagttgagcaacgcgcccactacccagtaacgaacatctacaagttacgggaggccatgattaacgaggatcgccaatttgatctgcgggaagtttacctggccgttcaccacatcgtgaagtaccggggtcacttcttaaataacgctagcgttgataagttcaaagtggggagaatcgattttgacaaatcctttaacgttttgaacgaagcctacgaggagcttcaaaacggcgaaggttcattcacgattgagcctagcaaggttgaaaaaattggacaactgttgctagatacgaagatgcgtaagttggaccgccaaaaagcggttgccaaattgttagaggtgaaggtcgctgacaaagaggagaccaagcgcaacaagcaaattgcaacggcgatgagtaagttagttcttggctacaaggcggactttgcaacggtagcgatggtgaatggcaacgaatggaagatcgatttaagttctgaaaccagtgaggacgagattgaaaaattccgggaagaattgagtgatgctcaaaatgatatcttaacggaaatcactagcctgttctcgcagatcatgctgaatgaaatcgtgccaaatgggatgtcgatttctgaatcgatgatggatcgttattggacgcacgaacgtcaattagcggaagttaaggaatacttggcgacccaaccagctagcgcgcggaaagagtttgaccaagtgtataacaaatacattgggcaagcgccaaaggaaaagggctttgaccttgaaaagggactcaagaagattttatccaaaaaggaaaattggaaagaaatcgatgagttactcaaggcaggtgatttcttaccaaagcaacggatatcagccaatggggtcatcccacaccaaatgcaccaacaagaattggaccgaattattgaaaagcaagctaagtactacccgtggctagcaacggaaaacccagccactggtgaacgtgatcgtcaccaagcaaagtatgaacttgatcagctagtttccttccggattccttactatgttggaccgctagtaacgcctgaggttcaaaaggcgacatctggcgctaagtttgcttgggcaaagcggaaagaagatggggagattaccccttggaacctgtgggataagattgaccgtgctgaatcagctgaagcctttatcaagcggatgacggttaaggatacgtatctattaaacgaggatgtcctgcctgctaacagcttgctataccaaaagtacaacgtcttaaacgaactaaacaacgttcgagtgaatggacgccgcctatcagtcggaattaaacaagatatttacactgagctcttcaagaagaaaaagacggtgaaggcaagtgacgtggccagcctagtgatggcgaagacacgaggagttaacaagccaagtgttgaaggtttatccgatccgaagaagttcaattcaaatttggcaacctaccttgatctaaagtcaattgtgggtgacaaggttgatgataaccgttatcaaatggatctcgaaaacattatcgagtggcgttccgtctttgaagatggggaaatttttgcggacaagttaactgaagtggaatggctgacggatgagcaacgttctgcccttgttaagaaacggtataagggctggggacgtttatccaagaagctactgacgggaatcgttgacgagaacggccaacggatcattgatctgatgtggaatactgatcaaaacttcatgcagattgtcaaccagcccgtctttaaagaacagattgaccaactgaaccaaaaggccatcaccaatgatgggatgactttgcgggagcgggtcgagagcgttctggatgacgcctatacttcaccgcagaacaagaaggccatctggcaagttgttcgggtggtggaagatattgttaaagcggtcgggaatgcaccaaagtcgatttcaattgaatttgcccgtaatgaaggcaacaagggagaaataacccggagccggcgtactcaattgcagaaattatttgaagatcaggcccatgaattagttaaggatacgagcttgactgaggaattggagaaggtaccggatctttccgatcgttattacttctacttcacccaaggtggtaaggatatgtacaccggtgatccaatcaacttcgatgaaatttctaccaagtatgatattgaccacattttgccacaatccttcgtgaaggatgattccttagataatcgggtgttaacgagtcgaaaggagaataataaaaagtcggatcaggtaccggccaagctttacgcagccaagatgaagccatactggaatcagcttttaaagcaaggattgattacgcaacggaagtttgaaaacctgacgatggatgttgatcaaaccattaagtaccggtcacttggattcgtgaagcgccaattagttgaaacacgccaagttatcaagttgacggctaacatcttgggtagtatgtaccaagaagccgggacggacatcattgagactcgggctggtttaactaagcaattacgcgaggaattcgatttaccaaaggtccgtgaagtaaacgactatcaccacgcagttgatgcttacctgacgacgtttgctgggcaatatttgaaccgccgttatccgaaattacgctccttcttcgtatacggtgagtacatgaagttcaagcacgggtcagatctgaagctacgtaactttaacttcttccatgaattgatggaaggcgataagagtcaaggtaaggttgtcgatcaacaaactggtgaactgattacgacaagggatgaagtagcagattactttgattgggttcaagatttaaaattaatgttggttacaaaagagcttaagcgtagtaatgggaaattattcgatgcaactatacaaaatgctaactatacaaaattaaatgaacgcaaaaaagtattcgttcctttaaaaaaagagttggacaaaacgttatatggatcttattcgggaatacaatcaagctatatgacaatagtaaaaaagtttgataaaaaaggttctacctatgcggtacaaagaattcccgttatgtattctaaattactagaattagaaaaagaacaaagtaaattgaatcggcttgtacagtctattgttacctcagatccgcaagctcccaataactttgaagttttgatgccatgtgtactaagtggtcagttagttattgataatggaagaaaatttactttaacttcctatagataccaatgtagtaccgcacagttattcttacctaagaaagatcttaaatatattcagaacaacttcaaagagttaaagaaaacccctgacaaacaagacaagatatttgaaactatttacgacgatattctaaaacaagtagataagtactttagtctgtacgatattaataagtttagatcaaaattgcatgatggaaaggacaagtttttagcacttgaaaattttggtgaaaaggaatcgaaagataaggtaataaccaaaatactacgaggcttgcacgcaaatgctgaaagaacaagtttgaaagagattgggttaagtacgccgttgggacaattccaatcaggagaaggcgggatcacattatctgataacaccaaaattatttatcaatcaccaacagggttgtttgaacgacatgtttatctaaaggatctttaagaacataaaaaaggagccgatcaaatcgactcctttttattatatgtatggccagaataacatggctcaaaagtaataactcgtgggaaaccactcgtttgatcttgactatgagtgttagatcagtagtctcgaatgtcgggagctacccgacaagttatattatatgaaattcggttgaatttgacaaggaggaattttaaaaatgggatggcgttcaataatcattggtcaacatgcaaagattacccactctgctcatatgatggttgtgcagactaaagatgggattaatgaaattccgatggatgatattgcaaaggtactagttgaaacaactcaggcgatgatctcttcagatttcatgagtgcatgcctacaacggaacattaaagtaatctttgttgatcgaaagtaccaaccgattggggagacggttggttatcagccagtagcgagggattatgaattgttggaacgccaattcttatggcccttggagcgaagggaacaactttggactaggattgcccacgccaaaatcgagagccaaataaaggtggcccggcttaatggatgcccggttcaagaactagaaagtgagttagaagccattgaagtaaatgacgtttctaaccgtgaggcagtggttgctcggaagtatttcccattgctgttcggaaaagattttagccgacgacaggagaatcaatacaacgccgctctggattacggatatgcggttttattggcggagacaaaccaatcgattacggaaaatggttatctgatggaactagggattcatcatcaaaatcgagaaaacaggtttaatttgggttcagatttgatggaaccatttcgaccagtgatcgactactgggttacaggacaaaagtttacggaattcaatcgccaagtccgagttggcttagtggatgcactgcatatggtaatcaagtataacggaactgaaatgctaactcagaatgccgtacgacagtatgtacgggaatgccttgattacttgagtggtgagcgggatgaaattgaagtaaaggtggagtttaaagatgaggtaccgaatcatgcgcttaatggtcatgtttgatttgcccacggacactagtcagcaacggaaacaatatcgtcagttccgtaagaagctgttaaatgagggatttattatgatccagtactctgtctacgttcgcgtatgtacgacaaggagtgcggctgagtttttggagagaaggcttaaggattatttgccagaccaaggagtcattcaatcattaatgctaacggaaaagcaatatagtgacatgcatttcttgcttggtgacgagattgaagaagttagaaattcatcaaagaggacgattgtactatgaaattgcaataccatggccatcaaccagttgaactgatgcctggaaaagtagtgattttgcaaatagagaacccaagcgtcaacaccgaattaattcaggggttgcagggatataatgattgcttaaggatgattgacgatgagtaccaagagcttaatttgagtaaggtaatgaagtgggaaggagaccttgttcttaatccaaccaaacttgatagttaccaaacgtcactcgataagatgattgtcaaaaatcttagtatcgagaagcaagataggatgaatgaccttgctcgtgagatttactcagaaatgcaagattccctgttcgaattcgatttgccattggaggtcagatatgacgaaagtcttttgagattatacaaatatgcgaaaatcaagtatttgacgcaagtaataaggcaaccttatggtataattgaaaccgatctaaaattacatctcgaattaaaggactgtcaggttcttgggtattgtaatgtcgctaattacttattacctgagcagatacaggaattcgctactcttgttgagaaaaccgaattggcagttttattagtagaattctcagaaaagagagaaactctacaacaactcaaacaggatatttaccggattgatcgggacttcgtggactggcacgaatagaccgttagtttttaatgagaaaacaacggtcttggatgagtgtcagatcagtagttccgagcacgtaaaggaggtggaatataatgaaattatcgtcttggatgagtgtcagatcagtagttccgagcacttactttgaggttacttactttggcgaagagtcttggatgagtgtcagatcagtagttccgagcacggaactcgcccgtgctaggatcggatccatgtcttggatgagtgtcagatcagtagttccgagcactaacaaacagtgaatagcaaagacgggtaggtcttggatgagtgtcagatcagtagttccgagcactgatatgctagttatggagaattaaaatccgtcttggatgagtgtcagatcagtagttccgagcacagaccgtgtttggtaagtcatcgagttgttgtcttggatgagtgtcagatcagtagttccgagcacacgctgataagcacacgtctgcagaagacggtcttggatgagtgtcagatcagtagttccgagcacaagcttgtatctatgactatctagccaatcgtcttggatgagtgtcagatcagtagttccgagcacagccgttgttaaggccagccaataaatcgcgtcttggatgagtgtcagatcagtagttccgagcacgtctgatatggcgggctgaccgttgcccccgtcttggatgagtgtcagatcagtagttccgagcactgagagcaacgaccattacataaaaggttggtcttggatgagtgtcagatcagtagttccgagcactgagagcaacgaccattacataaaaggttggtcttggatgagtgtcagatcagtagttccgagcaccgaacccgaagtgactggtaccgacccgaagtcttggatgagtgtcagatcagtagttccgagcactagtcgccctgttttaaagggggttcactagtcttggatgagtgtcagatcagtagttccgagcaccgactgatcgaaaacaaacattagattatagtcttggatgagtgtcagatcagtagttccgagcaccacgatcccgaagacgacgtaatcaatacgtcttggatgagtgtcagatcagtagttccgagcacccgttgcgatgattaagacaacaagtgcaggtcttggatgagtgtcagatcagtagttccgagcacgacgattgatctagcacatgcaagctatcagtcttggatgagtgtcagatcagtagttccgagcacccatgaaaatgggccgactggttatgctgctgtcttggatgagtgtcagatcagtagttccgagcactatgtacaacggtaagccaatcaataatcagtcttggatgagtgtcagatcagtagtcttagaattatagactaagggcattgctgtttttagcaatgccttttttagaagtgatgagggaaaggtaaatgttttcacgttggtaatctgacgggaactttagtgggcgatgtgctaggatagggccaaaatgattggaagtgtttgccatgcaaattgatcccgaacggattcgccccgaactgcgccgaatcggcaaggtggggtacgcaatcaacctgatggccagcccgcacgcctgcaacgaatgggacgaataacggcgaaggcgaaaatgcccattaactcgcggcgggtgatcaaacaagacgtttggattgaacgccctgaccatagcaatcttcggctggctattttccgggccaagcaagttgctaccaagcacccggccaccgggatcctctggttgcacgggggaggctacgccttggaaaccgccgaaaatgccttggtttatgctgaacagttggtggctgacggacggtccgtgatggtggcgccggaatacaccacctcggcgttggcaccgtatccggcggccctagacgactgttacctagccttgacgtggctaagggataacgccacgaggttcggggttaaccccaaccagttggtggtcggcggcgattcggcgggcgagggcttaacggcggccgtctgcctacgggcccgcgaccaaggggacgttaagattgactggtaaatcccaatctatccgatgctcgacgaccggctggtgttagcctcggccaagaataacaatgctccggtgtggaactcccgggttaatcaggcagcctgggacctctacttaggcgacttgctgctcgacaagattccaatttacgccgcccccggccgggccaccgacttggcgggcctgccgccggcgattacttacgttggcgacctcgacccctttttagatgaaaccagtttgtacgctaagcgcctcgaacgcgtcgggatccccgttgcttgcaaggtctttgatggttgctaccatggctttgaccaagtggccccgcacgccgacgttacgaaagtggcccacgactttttacgcaccgaattcttcaaggcccagaccaagtactgggcggaaaactaggaagcgcaaaccttccgtatgtaaacaccaagcgcccagattgcattacgtaatctgggcgctttcgtcttagtatctattgaaaaggtggcttgatttgaagttggaattaccattcggattgctagtcgctccactcgctatctagcaccccgtcttccaaactaacatccttttggcgtagttcgtttccttgaaaaccattctccttaaagagggaagggggaatggggcggaaaatgatcgtaccgtcagcggtctgttctaccgtgtaacattgaccgtcagggatgccaaactcctttggaatgacgaacgccaatgagtcgccaacctgttggactttcagtttcatggtctgcctcctcgctttttagggtacgtttagtatgcgctaaagtggtggaaaatgcattcaaaaggatctaccgtgtttaattttgccggtacccaggaaacgacacccgacaaatttttagatttgcgcaaagaatgggggcggtagcctagaaccccagtgctaacgtggtttgttgaggatgggtaattggccattgcgccaaattttagatttgtcgtgtctctattttggggattttgccaaacgtcagggcgctgcggtttaactacgtctactgggcccggcacgactaccgccactggtaccagttcggttgggtcccggtgaccgtgtacgccatgaacctaccgggtttcttggccggccgcagcctcctgacgccgttgaccatctacgccggccaaaccagtgattacaaggagttggccttaaacatcgccaacttccccaagttcttgcaactggcctttccgacggcggtcctcgactactacgaactgctcaagcgggggctaatggttttgacctgcctgattctcttggccggcttttggtatctgcgccgcctggacttgaccccgcaacgtttcttggtggtggcgacctggagcttttggacctgcacgatgttcttgccgtcgatgcacgaccgttactcctacttcgtgatggtgatgctagccctcgtcgccttattggaccgccggatgatcggcgttgccctggtttcgatcgggatcagcaccgtgctttacctgcgctacttgcttaacgccgacgcggcgatcgacctctggccgctggcgatcatccaaatcatcaactactgtggctttacggcgggcaccttcttgcacccgcagccagagtatttgcacagttttagataaaaacaacgcccacactttcaactaggaaagtcggggcgttgctttttttaatgttagacaggaaacctgtgaaataaccgcaggcctagtgcctaagcaggacgaagaacggtgcgttgcgcaccaaccgttcgccctgacttagtcatacgacctgccaaggaggttatttcacactctgaccttagccttgaatcttagccatcccgttcttagcgatttcttccagggtcttagcggagtcggccatcgccttggcttcgcgttcgtccagcggaacttcgaggacttcggcgatcccgttagcgttgatcacggccggggtaccaatgtagatgtcctttaagccgtattcgccgctcattggggcaccaactggcaagacggcgttttcgtcgcgcaggatggcacgggaaatccgcatcagggcagtggccacaccgtagaaggtcgcacccttggagttgatgatggcgtaagccttgttacgaacatcgtcttccaacttgtaaaggtcgtccttggaaatgcccttggcttctgccagatcgtacagtggtaaaccaccgatcgttgcagaggagaaggcggcaaattccgtgtcaccgtgttcagccatcatgttggcgttcacgtcaaccgggctaacgttgaacagcttggacaaaccaacccgcagacgagcggagtccagggaagtcccggaaccaaccaccttgttgcgtgggaagccggagaacttttgtacggcgtaagttaagatgtcaactgggttagcagcgactaagaagatcccttggaaaccagacttaacaaccggttcaacaacggacttgatgatcttcaagttcttgtcaacgaggtccagacgggtttcacccggcttttgtggggcaccggccgtgatcacaaccaggtcggcgtccttgcacgtgtcgtaatcggcgccgtaaaccagctttggggccgtgaacggggtagcgtcttcgaggtcgagggcgtccccttccgtgcgcttcttgttcaagtcaatgatggcaaattcttgggccaacccttgttgaaccatggcaaaagcgtaactagaaccaacggctccgtcaccgattaaaacaactttttgatgagtcttagacacagtaattcactccttaaaaatctcttaaccacgataaattatcggtcgcttgccattatagcatgtttgctcaataaatggctaatttgtgaaaaaacttcccgcaaaaattaggcagattaggatcagaccgggaataataaggattttaacggcgaagatgatcagtgcaatagtgatcaaaagccccaataaccaaaaggacatcttcaatagtttccacataatccataaacagattagcaggataattaggcccatttttgaactcctccttttaaagttggtcaccgattatagcacggcgaatttgaagaaggggtgaacttaaccaatccttagggaagttaggtgggcgaatgttagacagcaaacgtggtcaatcaccgcaggcctagtgcctaagtacagccgacttgctggggaggtgattggccactccattaaaaaacttgagatttcttaatcccttgcctagacctttggcaagcagggcgctgtgtgttaaaataggtccattaaagacgaaaaagcccacgacgggtccgatgataaggaggtgattaccatgctaaatcgcaccaagcaattcatgcgcgaacacgatcttacttataagaaagaatacatccggccaatgatgtcgccggagcacgtttacgttttccggttcggcaagcaccggctcaacaatcgggtaatcattcgctactcccacacctggacggggcgggtaaagattaacgaaatcgacgtccggatgcatcaccaacaccacccgcggatcttcaagaccgaagatgacatgttggcctacctggcccaccacttagaaaagcgggaagccaaagaggcgacgcgggttcacaccggcgaagaagaataagaaaaggggcgtccgcgggggcgccctttctttcaggaaggaatgaatcaataatatgaattggacagccattgtggtggaaaccagcaccgaagccgtcgacgcggtttcctacattttgaccgacaccggggcgaccggggtcaagatcgacgacgcggccgactaccaaaagctcaagcccggtaagtacgggccctacggcgaaattgtcgacccgagcaccttaccacaccgcgaggagggggcggccgtgaccggctactacccgcccacgacattcgtgcccgaaaaaatcgccgacatccgccagcgggtggccaagttagccgacttcggcctcaacccggccccggccagggtcgctgccgaagaaatcgataaccaggactgggcgacggcctggcaaaagtactaccacccggtccgcgtcacccgtgagctgacgatcgtgccacagtgggaggaatacaccccggcgacggccgatgaaaagctgctcgtcttggacccgggaatggcctttgggaccgggacccacccgaccacccagctgatgctccaagcgttaacgatcgccctacgtggcggtgaatcgatgatcgacgtcggaaccggctccggggtcttgtcgattgcggcgaagcaactgggcgccggcgaagtctgggcctacgacatcgatgacgtggccgttaagtcggccaaaaagaacctagcgctcaacccgatcgctaaagacgttcacacaggggttaactcactgttggacggcattcacacccaggtcgatctggtggtcgccaacatcctggccgaaatcatcctgccattagtgccacaagcctttgagaacctcaagccgggcggcaagttcttgacctccgggatcatcaacaccaagtttgaaacggtcaagaaagccatcgaagcacagggctttgtggttgacgaaacgatgcggatcaaggattggtacgggatcatcgcccacaagccagcaccggaggaagcctaatgcaacgctactttgttgaccaagcactaccggcccaccgccgcttgaacctccctgacgacgtgagccaccacctgattacggtgatgcgggccgcggccggcacccaagtcgaactggttttggccgaccaccacgcctacttagcgaccctcttggacccggcgacggccgaagtcaaggtcgaacaagacctcggcggcgacagcgaactaccgatcgaagtgacactcgcctgtggtctgcccaagaccaaggaaaagccggaactgatcgtgcaaaaggcgaccgagctgggcgccaagcggatcatcttctttgaaagtgcccgctcggtgagccactggaacgaccagcgccagggcaagaaggtcgagcgcctgcaaaagatcgccaacgcggcggccgaacagtcgcaccgcgaccagattcccgaagtatcctacgtcaaggacctcaaaagtttgttaactgtcttttcgttcgatcaccgagtggtcgcctgggaagagtcggctaagcagggcgaacgggcggccctggcaaccgtctttgaccaggtgacgccggggcaaagcctgttggccatctttggtcccgagggcggcttgaccgaaactgaggtcgaaacgatgacggctgcgggcgtggtggcctgcggcttggggccgcgaatcttacggaccgaaacggcgccgctctatttaatggcggccgtttcctaccattttgaattagccgaacattagccgctaaatccaaccgtggtttgtgctaaaataagaatactaataatcaatcgtaagggatgaagagtttgaagagtttatggcagcgggccgaccgtcgtttgtgggtcctgagcatcttgatcgggtttgtcgtgacctggttagttaacatcgtaccgtttatcaacaaggtggagcgcttcgccgttttctacctgctcttgtacggggcctttgcaatttggactgggttcacccttcaaaaccggcgccggtgttggcaagcctttgtcttcccggtcagttttctgctggcggcccacctgtttggacccaagtacagcctgtattttgcaccggcgtacctggcggtggcctacctagcgtggtcaatggtgcgagctaatcggaacaagtaaaaggggggtggcttgatgtcgcagacaaaggaattaacgcacgaagacgtcaaaaacatggttgccaagtacatgaatgaggagcacgtggccctagtggagcgggcctaccacttcgcagccgttgcccaccagggccaggttcgcaagtccggtgaaccctacatcattcatccaatccaagtcgccggaatcctggccgaattaaagatggacccggaaacggtgtgtgccggctacatgcatgatttggtggaggataccggcgccactttggatgacatcaaggagctgttcgggccgacgattgccatgatcgtcgacggcgacaccaagatctccaagatccactacaagtccaacaaggaacagatggccgaaacccaccggaagttgttgctcgccatgagcaaggacatccgggtgatgatcgtcaagttggccgaccgcctgcacaacatgcggaccttaaagcacctgcgcccggataagcaacggcgcatctccaacgaaacgctggaaatctacgccccgattgccgaccggctggggatttcgaccatcaaatgggagctagaagacctgtcgttgcgctacttaaacccgcaacagtactaccggatcgtccacttgatgaactcccggcgcgaccagcggattgactacatcagcgccgctatcaaggtcgtgaaaacggcgatcgccgacctcgacctcggccccaacgttgaaatctacgggcgccccaagcacatctactctgtctaccgcaagatggtcacccagcacaagcagttctcccagatttacgacctgctggcgatccgggtggtcgtcgattcgattaaggattgctacgccgtattaggggcgatccacacttcctggaccccgatgccgggccggtttaaggactacatcgccatgccaaaggctaacggctaccaatccctgcacaccaccgtgattgggcccgagggccggccgctggaaatccagatccggacccaccaaatgcacgaggtcgccgaatacggggtcgccgcccactgggcctacaaggagggcaagaccaacggggtcgatcaagccagccaggattccaagaagctcaacgtggtcaaggaaatcctcaagttgcggagcgagtctaacggtaccgacgagttcatgcaggggatccaatccgacgtcttcgccgataaggtttacgcctttacgccgaagggcgacgccatcgaaatgccgaagggcgccggaccgttagacatggcctaccaaattcacaccgaagttgggaaccacaccaccggggccaaggtcaatggtcggatcataccgctcaactacgagatcaaaaacggtgacatcgtcgacattttaacctcgtcgtcatcggctgggccgagccgcgactggatggacctggtctccacccggcgggcccgcaacaagatccgccagttcttccgcacccacgaccgcgaggaaaacgtgatcgaggggcgccggatcatggaacaacagctcagggacgccggctacgagccagccgagttaatggtcagcgataaggaagaagagatcgccggcaagctccactacaagaccgccgacgacatgtacgccgccctggggtttggcgacatcgccccgatcggcctgcggaaccggtttaccgaagacatccgtaagcacaaggaagaagagaagcaaaacgccgcccaaaaggcaattctggaagggcacaagaccctagaacaggagccgccgacccgccagaaggtcgctaagtcttccgaaggggtggtcgtcgaaggggtcgacaacctcttgacccgcctgtcgcactgttgctcaccggtgccgggcgacgccatcgtcggctacatcaccaagggccgcggggtctcggtgcaccgggccgactgccccaacatcaaggcggccgaaaagagcggccagcgggtcgtctccgtttactgggcgaacccagccggcgacaagaccaactacaacgccgatattgaagttgagggctacaaccgcaacggcctgctcaatgacatcatccgggcgattaacaacaacacccgctacttgacgtcgatcaacggtcggatcgaccacaacaagatggccaccatctcggcgaccgtcggggtgcgcaacttccagcacctccagttgatcatggattcgttaaagaacctgccggacgtgtacgtggtcaagcgggtcattcactaggaggagtttatgcgtgtagtattgcaacgggttaaggaagcaagcgtcaccatcgaagggcaagtcgtcggccaaattggtcagggctacttgctgttggtcggctttggtcccgatgacaccgaagagacgctcgattacatggtccacaagattaccaacctgcgggtctttgagagcgaaccgggcaagatgaacctgggcttaaaggacgttgacggcgctatcttgtcggtctcgcagtttaccctgtacgccgacgttaagcacggcaaccggccgggcttttccaacgccgccaaaccatccttagccgaacccctctaccagcgctttaacgaaaaactggccgccaccgggatcccggtggcgaccgggcagttcggcgccgatatgcaggtggccctggtcaacgatgggccggtgacgatttggtatgagaagtaagtgagtgcgaccaaccttctcgacgggccgtatggctaagctagggcgggggttggtgccttggcaccgttctccggccgtacttagctactaggaccgtggttgggagcacgttatcaagtgagtgtgactcaactaaatatcgaaaacatagctggagatgacgttgttaagacgccgatctccagctattttgcttctaaagggattcgttggctgtcaaaacctaaagtcagctactgcaattgcgttcctgaacaacctttcgttaacttagccacattaattacgcgtgatataaacctgacgtgttataatgtcaatatatattacaagtgattttaaggggactttcgatgaccgattaccaaacgattcgcaaattgatacaccggctgcgcgaggccgatgccaagtggcaggtgacggcccaacgggaaatggccgagcgctaccgggaggtgttgccggagccggttttgcaacggctacgttcgaaccgctttaaccacgccgaattagagctcctcgacttggttgccgccgctggcaaacgagggattgcctaccaggaagttcaagccgaggtcttgtactcccagagtctggtgtcgcgctacaccaaccggctggctaagctggggctcttggtaaaggagcacccggaatacgtccagaaggcctaccaactgacggtgacgccggccggggaaagaatggccgtccttcacgccgagttgcaccgccaggaaagcaagttttttgaccaacgtctcaccagatggtcaccagaggaggtcgcgacgacaatcgcggtcttaaagagtttgaccagggaaaaataagttggtgttggtggttgacaagtggggcgcccctctttatactaactataatttaatttaaatctaatgttcacgttgatgagaagagtagcgagcagcgccgttttcagtgaccgccgtaagtgcaaaggcggacggttaaccccgcgaagatgagcttggagtgttgaaaagtggtcgcagggctgcttttccggtaggacccgttactgtccctggcatccatggggtgctgtagaggccgttagggtaatctagcggtaaacaagggtggcaccacgagtaatcgtccctggattttgatgatccagggacttttttttgtacccgcaaaaggaggaattaaccatgactaaacttgatacccagctggtgcacgggccagccgttaatgacaactgtaccggcgccgtgaccacgccgatttacaaggcaacaacctttgaataccccgaaattggggcgccggtgacctacgattactcgcgctcggggaacccgacccgccaggcggtcgaaaatcaactggcgaccttggaagggggccagcgggccttcacctttgcctccgggatggccgctatccacgccgccttggcgatctttaaggccggcgaccacctgatcgtgggtgaccaaatttacggcggcaccttccgcttgctttaccaatttttcgcccgctgggggcttgaaatcacggcggtcgacacccgcgacccgcaagccattgaggccgccatccaggacaacaccaaggcaatttactttgaaccggttaccaaccccttgctgcaggtgacctcggtacgccaggtggccgtgattgccaagcaacacgggctcctgacgatcgtcgataacacctttttgagcccctacctcttaaagccactagagctgggcgccgatctggtcatccattcggcgactaagtacttagccgggcactcggaactctcggccggggccgtgatcgtcaacgatccgcgcttagccgaccgggtttacttcgtccaaaacgccctcggcgggattttgtcgccggagggggccaacgaactggcccgcgggatcaagacactcgggatccgcttggaccgccaaattgaaaacctggtggaagtcgtgaagttcctggaaacccggccggaagtccagcgggtgtactacccggggttgccgggccacgagggttacgaagaattgcgccaggaggccaagggggccggggcggtgctctcctttgagctaagcggggcggtcgacccggtcgccttcgtcaacggcctgcgcctcttcacccgcgccgttagcctcggggccgtcgagagcctggtcgagttgcccagcaagatgagccacgccgaattaacgtccgaagaacagttggcggccgggattaaaccggggctgatccggttggcgatcgggatcgaagacgtgaccgacctgattgaagacctcgcccaggcgctggaccaagccgaactagtgactaccaaaggaagtgttgaagatgaccaaacaaccgcaatcaattgataccattgccgcccaagcggggagccatgaggatcggggcggtgccgtttcattccccctctacttttcgtctaattaccgccacgaaagcctagcggaggccaaggcctttgacccgacgactggctactcctactcgcggctggcgacccccaaccggcgcctgctagaagagaccctcgccaagttagaagggggccagtttggctttgccctgagctcggggatggcggcgatccagttggcgctgagcatcttaaagaccggcgaccagttgatttctttagacgacctgtacggcggcgatttccgctactttcgttacctggcgacccacgccgggatcaacttcgcccagtggaacggggagcgaattgacgatttgcttgccatgattgagccgaatacccgcctgatttggctagaaacgccgtctaacccgacgatgaaggagctcgacatcgcggcgattgccagccgggttcacgccacccgccccgatattttggtcgccgtggataacacctttttgaccccggtctatcagcgcccactcaccctgggcgccgacatcgtcgttcactcggcgaccaagtacctgtcggggcacaacgacctcctgggcggggtgctggtctgcaaggacaaggacttggccgatgaatactttgactactacatcacaaccggcgacaccctggcggcctttgactcctggctcttgttacgcagcctgaagacgctcggggtccggatgcgccaacacacggccggggcccaagcggtggtggcttatttaaagcaaagctccgccgttactaaggtcctttacccgggcaagggcgggatggtctccttttacctgagggatgaggcgaccgtcgaacggctcctcaaccacgtttcggtgatcacctttgccgaaagcctgggcggggtcgaaagtttgatcaccctgccgtactaccagacccacgccgacgtcgaggaaaagcaacgggaacggctgggcatcaccccaaccttactccgtttatcggtcggcttagaggacccggcggacttgatcgtcgacctccagcaggccttgggggaaggttagaaagggtgcaccgattttaatcaaaaattcatataaatttaattatgctattgacagggatcggaatggctcgtatgatgagatcattcttacaaaagattagcaaacgaagggagctgaaatcatgttacgtttacgacaagtcatgtgtatgtgtactcaaaatgacatccgaactgatgtggtttcagttggggctgtttgagtacactctttttgctaagggtgtctaataacaccccttaacctgtacaagggctactgaccatggatggtcggtagcccttttttgttttacgctgaagggtggtggataagggaaaaagttgatgtagcgcagggaagaaaaaaagaaatgaggaatagaaaatgagtaagttaggaaaattaacaaagttagtactggtaaccgttttaggaatctctgccggagttggaattttgcaaaccaaagcctccgctgcaagcaagacggtgacgtttggatctactggggttagctacccgagttccttcaagtcaaatggaaaattaaaggggtttgacgttgaggttgttaacaaggcatcaaaacggcttggctacaaggttaaatgggtgaacgctgattttgacggactcttaggctccttggatagcggcaagattgatgcagttgctaatgatgttgcggttactacagagaggcaacaaaagtatgcatttaccactccttacagctacgatccaactgcagttgctgtaagtaaggattccaagcttaaaacgctcaaggatttagagggaaagacagttgcggccgttgttgcttctaacaacattaagtcacttcaaaattatgattctaagatcaagatcaagacttacgaaacccgtgatcaagcatacgccgctttaaactccggtaaggtagcaggggttgtgaacacccggccaattctatcagcaacgattaagcaaaagaagcttgactggaagatcttgaaggggaatgcagcggaaaacaaggttgccattgccttctcaaaagatgctaagggtaagaaattagcaaagcagtactccaaggaaattaaggaaatgaagaaagacgggacgttagctaagctttccaagaagtactacggatacgatacgtctaagaactagttaggagagtaaccatggttgatcgcttaggagttgagaatgctaagaaattgcaagaacttcttcaccaagcttaccaaggtgatgagaaacttgggattcattttggagctacaacggttagctatcaaggagtgattgaacatttaaaaagtaccccgaccttcgcggtaaaggatgagcaacaaattattgccaccgtttcagttcggctaccgtggtcaaataatccaggaccatatgcccttcctcacttagggtgggtggcaacgaatcccgcctatcaacgtcaaggaaaggctaaagagttaattgactgggttattcaagaatatgttgcaaaggatttaaaagcagctgcagtaagtttaggaaccgcattagagcatccttggttgagaaagacctatcaaaagcttgggtttgatgaagttgagacggttagaaagtttccagatcaccaaacagtctatttagtcaaagttttggatgaggctcgttatgtaaaagcaaagtcaattgttagcaaaaaccattagaaggcagtcaaggaggaaaacatgaagtttgatttctcatattttataagtttgtttggacagttattaccatttgttccagtcaccttattaatggctgtcgtttcaatggcattggcaatcgtattagggttagcgattaccttattggaactgtctaagattagggcattacggctgtttgccaagttttatgtatcgttatttcgggggatgccaaccctagttcaactgttcattgtttattatggtttgccgcaaattttccctgcattgcgaggtattccagcgatgttagcggcgttagtagggctcggttttaaggaatcctcatacctcgctgaaattttccgtgccgctatcggttcagttgatgaaggacagattgaagcagggaagtctcttaacattaaaagctccaaattgtttttccatgtcttactcccccaagcaacagttaatgccttgcctgcaactggcaacacttttgttagtttgattaaggaaacttcccttgcttttgcattggggattacagagctgttcgctgaaggaagaatgcttgcaggggattcatttagatattttgaaacttacgttgccattgggcttctctactgggcggtaatcattatttactcttggttgcaggggattttagaaaaggccttacaaaaaccatatcggaggattgcatatgtcactaatcaaagctcggaacctatccgtgaaaatcggtcagaagcaaatcttgaaacgaattaatcttgatgttgaagagggaacggtgacggcgtttattgggccaagtggttcaggaaaaacgacgcttttgcggacactgaacttacttcaagaaccgtctgaaggaacaattgaggttaacggaacaaagattgaggcgggaaaaattgataagcgccaagttgaggagcttcgccagaactctgcgatggtttttcaacaattcaacctctttaaaaatatgactgcgcttgaaaacgtggccgcaccattaattttaaacgggcagttaccaaaaaaagaagcccgtcaattagcacgtgaggtgttagctgaagtgggattagaacaggtggcagatcaatatcctatcaccctttcaggtggtcaacagcagcgggtatcgattgcccgggcaattgcagttaagcccaaagtgatcttgtttgatgaaccaacctcggcattagacccagagttagtaggggatgtgctacaaacgatcgccaaccttgctaaggaacatatcacaatgatattagtcactcacgagatggattttgcccgtcagattgctgaccaagcggtttttatcgaagatggggagatttttgatcagggaccagcaagtgagttgctttctggccgtggtgcgggaagaatcagttccttcgttaattcacttgaaaaagtagcggtagaaaaataattggaggcatttaaatggtagagagtagctttgcagaaataaaagacgagattattgagacccggcattacttacaccaacacccagaactgtcagatcaggaagttgaaacaagtcgttttattactgagtacctcttaaatatagggtatcgaattatcacgccagtaggattgaaaactggtgtcattgcagaaattggtgagggtaaaccagtagtggggttgcgctcggatattgacgctctccccattaaagaagcaacagggctcccttacagttcggaaaatgaaggggtaatgcatgcatgtggccatgattttcatatggcttcactattgggagcagcccgagtgcttaaggaaaaagaagcggatctagtggggactgtgcgtctaatcttccaaccggcagaagaaactcacgttggagcccaagaagttgaagaagcaggggggatcgaaggggttgacgcaattattggttttcacaacaagcctgatctagccactggtgaaattggaattttacctggtggtctgatggctgcagttgaccagtttaaagtaacctttaagggagtaggaacccatgcggcaatgcctcaatttgggaaagatcccattattgcattagcagggactgtttcagcggttcaaacaattgttagtcggaatgaagatccacagaaaacagcagtcgtgtcaattactcacattgaaggaggttcaacctggaacgttctaccagaaaatgcgtggtttgaagggacggtacgaacgtttgataagcaggcgcgacaggttgccaaggaacgcttttacaaggttattgaaggacaagcagcgtcatttggagtggatgttgaaattgagtggattgaagggcctaacgttgttgataatgatcctaagcttacagaaatcgttagcgaagaaactcaaaagcaccttcaattggtaaaaccaacaccttctaatgccggtgaagatttcgcctactttagtcaaaaaattccgagtgtttttgcctttgtggggagtaatggtaattctgattggcaccactctgatctacgggttgatgatgaagggttgcttgttggtgctaagtggtattactacactgcgcttcgtttattgagtgaattgaaaacaacgggggcaaaatagatgagtagtgttttagattcaaaattgatgcaaggaaactttagtactcctgaaatccgggaaatttggagtgaccacaacaaattgcaagcacaattagtagtggaagcaacactgtcagaggttgagggtgaactaggggtaataccaccagaggcaggtgaacagatagcccaagttgctaaggtggaaaattttgacttggatgcgctagtaagagagagtgctgaaaaacgtcattccctaattgctttgattcatagacttcaatatctagcaggggaaagcgcaggggagtttgttcactttggggttactacgcaagatattgttgatacgggaattatgttgcagactaagcaagcctttgaagtgattttggagcatacacaaaagttaattgaagtcttaactgagcaagtacaacgttaccgtgaaacgcccatgattggtcgaacacatggcattcaagcaattcctattacctttggctttaaattagcggtatggttagatgaactagtccgtagttaccaacgattacaaaccctaattgatcaccaggtttttgtgggtagtattagcggggcggttggaacatacgctgcgtttggtggtgatggtcctgccgtagaaaaggcagtattaactcgtttaggcttggacgtacctaatatttcatggcaatcttcccgcgatcgactttctgaaattgcagaagttttggggatttattccgggaccttagggaaaattggccatgagctatttaacctaatgaaaacggaagttaatgaagtaaccgaaccatttaaaaagggggaagttggttcttcaacaatgccacaaaaacgtaatccagctttactagaggggcttgctagtttaacccaaccggtatttagcgatgtagcgttaattcaccaatcaatgctctttgatggggaacgagatgcgattcattggcgaaatgagtgggtagctctaccagaaattacaaattacttagatgctcaaatcgttaatgctacatatatcctcagtgagctcaacgtgaacgaagatcaaatgaaaaagaatatcgctttacaaggtggactaccgtttgcagaaaagattatgtttgaattgggaacgatcattggtaaacaaacagctcacgaagtagtttatgagagtgccatgaccgcaattgaacaacaccgtaatttcttagaagtgctctaccaacgggaagaggtaaatcattacttcaagcggtctgaccttgatgaatgggcaaaagcggaaaacgaccttggaaacattagtcaacggattgaactcgttgtaaaaaatgcaggccgggttttggcaaagggggcttgggatcttgaacgagaccaggttagtcgcgaagcaattacagcaaaagagtgaagattcgagattaattaaggaagctagacgagctttaatcgactatttaggatgtgttttacaagctagaaaggaaccaaaagttcaagaatttggtcggttatggcagcaagaaggagggaaagtaaactcgcttttggggttacatgctacaccagagcgggcagcgctgatcaatggctttgctgctcactatctggattttgatgacgttcaagctaattttcgtgggcaccctagtgctgtgatctactcagcactccttgccatagctccaccaagtagccaggtgcggcaagtactccaagctttcatcgcaggagttgaattggcagggaagttgggattggccttaaatccggatcataccgttcaggggtggcactcaacagcaaccattggaacgattgcggcaacgggagcactgtgtaaccttgctaatgcctctgtggatcagactactcgggcattgtcatttgctacaagtcaagcgagtgggatgtcgtttcaaaatgggacggatgctaaaccgttgcaagcagggttggcagcacgtaacgcggtaaccgcctttatactctcgcagagcagaggctcctttactgcaaatgaagattccttgcagttctggggggctactttaggctttaacgaaaccagttttagtttgcttggtaacgattggtatcaaccgggacaaatcaacaaaccaggactatggtttaaagtacatcccttttgttcagcggctttgtccggttatgaagcagcgaagatgttatggaacaaaggagttcggtggtcagattgtgttcaagttgttgtccactatccacctaatggcgatcgggcactaaatcagcaatggccacaaactggtcaagagtcaaaattctcaattgagttcatcatctggcaggtacttaaatttggtgatgttaaagatgctgattttacggcgagattcgttgacagtcagtttaaaatagacgtggccaagattgtcagaaaacacgatttggcaactacgtcagctacaaagcggccgacccttgtagagactgttactagaagaggaatagttaaacagttagtagtaatgccattaggatcaccaaataggccgctttcttctgaaaagttacaagagaagctattaatggttctaccgaaggagaaagttgctgcgttggtggatttaattgtgaaaaaagaagcggtacttcaagagatatattggttgatacaatagctccgcccccacgtcaatgctcgccattaacggaggggcgctgctcgatcatcccaaccaattaacttaccaaaagttaaaattagaataaacttagatattgacattaattattagagggcttatccttacaatatcatcaaagaagggaagaatgttcaccatgccagctactaaactgcaaatgatgtgcgcaatgccatgttgtacgatgatgtgcaacatgttctttggcatacacttgcagcgtggtgaagctacttccgttaaatcctcgtacttattttaagtaagaggaatgggaagcccctgatcacactgtggtcaggggcttttttgatgaaattgaatggaaagagggtttgtttgtgtcctgggaaataattcagcaaagcttaccaatgtttgaacagggcttaattgcaaccctgtggctctcggcggtggggatcgtcggctcgctgattgtcggtgtgattgtcagcctggttcagttctttcgggtgcccgtcttacgccaagtctgcacggtttacgtggaaatttcgcgtaacaccccgctgttaatccagctcttcttcttgtactacgccttcccggtgattggtttgaagatgaacgccgtgacctgcgggattgtcggcttgatttttcttggcggttcgtacatggccgaggggttcactggtggttttgccggggttagcaaggggcagttggaaacgggcaaggcgatcgggatgaaccagtggcaactggcccgctacgtcgtcttcccccaggggtttgccctgagcatgccggcgctggcggccaacatgatctttttgatcaaggaaacctcgattttttcggtgatcgcgattccggaattgacgaacacggccctcgatttgattgggctctactaccggtccaatgaatacctgttggtcttggtgattgggtacgccattatcttgattccgctgatcttagtgttgaactggctggaaaggagggtgcgctatggcacattcggggattaacgtcttgttagagggatccaacttctcccggctgatgggcggcttatgggtcagcgtttggatcgccgtggtgtcgctcttctttggcttgattgtcgggacggtctttggggtcttgcggacgaccaagagcagggtgctccgcttcatcctgcgcttgtacctggaaatctttcggatcatcccaacggtggtgctcttattcttggtttactacatcctgccgcgccagttgcacattaacatgccggcggattggatggcggtgctcgccttttcgctgtgggtggccgccgaatttagcgacatcgtccgcggggcgattcaatcggtgccgcgacaccaacgcgaatcggggttggcaattggcttaacccgctttcagctcttccgttacatcctcttgccccaggcaatgaagctggaagtaccggccgccatcaacttggcgacccgggtggtcaaaacgacctccctgttgatgatcatcagcatcatggacgtcatcaacgtcggtcaacagatcatcgaagccaacaattcaacctacccaaccggggtgttttgggtctacgggttaatctttttcttgtacttcatcgtcgactacctgttgtcgctgtgggcaagaaagctaaccgcccggcagtaaggaggagcgtatgacggaagaaattttaaaggtaagtcacttaaataagttttacggtgactggcaggccctgcacgacatcaacttcgacctcaaaaagggcgaggtgttagctctactcgggccgtcggggtcggggaagagcaccctgatccgctgtttaaacgggttagaagagtatcgtgacggcgagatcgtctttaacggcgccaaggtggagcccagcgagaagaattggcaacggctgcgccaaaagatcgggatggtctttcaaagctacgacctcttcccgaacatgacggtcttagaaaacattttgttggggccgaccaaggtccaaaagcgcgaccgggcgacggtggagcaagaggccctggccttacttgaccgggtcgggttaaaggagcacgccaactcctacccgcgccagctgtcggggggccaaaaacaacgggtggccatcgttcgtgccttggccttgcagcccgaggtgatgctctttgacgaagtcacggcgtccctggacccggaaatggtccgcgggatcttagacatcatcaaggaactggccaacgacgggtcgatgacgatgctgatcgtcacccacgaaatgaactttgccgcccaaattgccgaccgggttctgttcctagaggacgggcgcattttggaggataccccgggtcagcaattctttaccaacgcccagaccaaacgggcgcgggatttcttggaaagcatggatttttaataagggagaaagcaaatgaagaagattcaaaaattaatggtagggttgttaaccgtcctgagtatcttttcgctcgtttcctttgccggcctgtcttcagccaaggccgacagcaaccaaagttccgtttcggcgattaaaaagcgcggttacatccggatcgccgtttttggcgacttacaaccatacggctgggtcaacaaggacggtaagcgggttggttacgacgtccggttagcccggcagattgccaaggacctcggggtcaaggttaagttcgtccaggtgaacgctaacaaccgggtcgacaccctgaattctaataaggccgacttggtcttggcaaacttcactgtgaccgatgaacgtaagcaagtgattgactttgctaagccatacatgaaggtttcgatcggggtcgtttccctgaagtccgacccgatcactaaggtcagccaattgaagaacaagagcatcatcatcaacaaggggacgacggccgaaaactacttcgtttccaaccaatccaagctcggcatcaagtcgatcttgaagtttgacaccaagacccaacagtttaacgccttaaagaacaagcgggctaacgccttggctgatgataactcctacctttacgcttgggttaagaagaacccgaagtacacggtcggcatcaagaccctcgggccttcccaagacatttccccggccgtcaagaagggcaacaagtcactgttgaactggaccaacaaggaaatcaccaagctcaacaaggacggcttctttaagaccgactttaacaaggaactcaagccgtacttcggtagtgaagtcaaggcttccgacattatcatcactaacgataaataacggggagcacgttattggaagtgcgactcaaccagtgggcaggccgtgggctaagacccagacacaggttagcgcgccagtggtgttctgtggctggacttagccactaggtctgcggttgaggagcacgttatcgggaagtgcgactcaacctgctcgataagttggggccgtaagtaatcctaacgcgcttctttgtcactacttatataggtgaaaaatgatttcagaaagacccgaccgttcggttgacgaactggcgggtctttttgcataccctcgccattaatcaatcgataaatatcattacaaagaaaccgttaccatggtataatgtaattaatgaaagccgcagaggatcgaaaggagatgctactatgggacagtttgacaataaggttgccttggttaccgggggaacgaaggggattggcttagccatcgccgagctatttttgaaggaaggcgccaagggggtggccttcaccggtcgtcacgaagacgaaggaaaagcggttcaagaacgcctcggtgaacggtctttgttcatcacccaagacgtttccaaggaagaagattggcaaaacgccaccaaagccgttgttgacaaatttgggcagcttgatgcgattgtcaacaacgccggaattgggactccgctggggatcgaggaaatgacgctcgatcactggaaccgcgaaatcgccatcgatttaacagggacgatgttaggttgcaagtacggggttaaagcgatgaaggaacatggtggcgcgatcgtcaacattagttcgatcgaagggatgatcggtgacccaaccgttccggcctacaacgctgctaaggggggcgtccgtctcctcaccaagtcggtagcgcttgagtgtgccgaaaagggttacgccatccgcgtaaactcgattcaccctggggtaattgccacgccgctgatcgatcacctcgatgatgcgaccaagcaattctacatcgacaagcacccaatgggccggctgggaaagccggaagaagtggctaagatggctgtctttgttgcttccgatggggcctcctttagcaccggctccgagtttgttgtcgatgggggctacacggcccaataaaaaggaagtgcgacccaaccgtaaagcaggccgtatgactaagaataggacacaggttagcgcgtcagcggtgttctgtggccagacttagccactaggcccgtggttgggcgcccggcaaaccacaggcaattaaaaaggaacttgcgcacgcgttgcgcaggttccttttttgcgtttattcgcccagtgccaaggcctctagccccgggtttgtggcccgcagccgttgcaagtctgtcggggttaacgcgggggtaagggcgctagtggcttggcgatcgctgaactgcaggccggttggcagtccagtcgggttaacgaccaggtagcgttgcttggtgagcggtcgcccgttttcaatgcgcaaacaggcgctggagccggtcagctgctcgccgcgactcaggctagccaggtcggctaagacgctgttggcagtcgccttaccgcccgccccggggccgaggtaggtcgaggtaccaaccaggtcactgtcaatcacgaccgcgttggtgaccccgtccacttggtagagggggtgggaagggttaagtgccactggggccacctggtagttaagttggccccggctttcccaagttgaggctaacagcttgatctttagcccccattccttagccgccgcaaacaggcggggtgaaaggtggtcgatcccggtcggggccagttgggcgagcgacagggtccggtggaagatcagcttggttaagatgattagcttataggcggcgtcgatcccggtcacgtccttggtcgggttggcttcggcaaagccctttgctttggcctcctttagggcggcgtcaaaggagagcccctcctggtcaatggcggtgagaatgtagttactggttccgttgaggatcccgctgacccggcggatccggtcgggggccagcccctcgttgatcgtgcggatgattgggatgccacccgccaccgccgcctcgtaagtcaaggcgccgccgtacagctccgctagccggtcgagttcggtgccggccgtggcaaccaggtccttattggcggtgattacctgcttgccgtggaggagggcggacgtgacggcctctttggcgaccccaataccgccgattagctcaattaccacgtcgacggtcgggtcttccaccgcccggcgccagtcggtcgtcaattgggcgccagtggggagtaagacggtttgatggcgttcggggtgtttaaccactacccaggctaattgccaagcgccgttggttgaggcaaccagttcgtcgaagaccacctggccaattgtgcccaagcccagcagggcgatccgtttgttattcatgttcattcctccttaaatggttagccagttggcgtagagccggcagctggtggtacgccaggaattgacggcctggtggtggtggtagtaattttgcggtgggttaatggtccgtccccgggcctggtcgcggtgaaattcttggtccaaggtgtcagtggcgtactcggggtgaccggtgataaagagctcccgggtgtccttggtggccagcaagaggccgtcagcaattccctgactcttagcgaccacctgcaggtccgcggggagggtcgccggcagtcggaggacgctgtggcgcgactggggcatccggagcttggtcaggccgccaaagagggggctcgctgggttaacccgggcctcgaagataccaaagagtttgtggggcagcggggccttggggatctggtagcggacgttgagcgccgccagggccgcccagcactcaaagatcgcccgccggcagtgggtcttactccaggccaccagccgttggaactcggcccagtagtcgacctggtcaaaggagagttcttccaccggggcgccggtgacaatcaggacgtcgaagcgggtcccccagagtcgatccagcggtaggtagtgctttaagacggccgcccgctggtggtggagttggtggctagccgggtaggcgaaggtgacgtcgcagtttaccccggtggcgtctaacaagcgtaggaactggagctcggtcgcctccttggtcggcatcaggttaacgagcaggatttggcgcgcccccggtgcgggggtggttgtcgaccaggtgtggtgggccctggccaggccgttagtggcgaacgctgtcatttcaaaaacccctttctaaatcaaaaaaagcccccgtcccggttttacaaccatgggacgaggacttcgtggtaccacccaatttcgctgccaaagcagccttagcgaggacatacatcccccgcacggtatcgggtgccaccggagcgggtagcccgaggacccccgctcttcctccgagatcatcttcacgaccttgatcagcacccctctcaccagccggggctctctgtaggtgaccgccgtcgctactcttctcatcaacgaaatttattaattacttttaatttaaaactaattaaatcgccattttaatcaaatgtcaatagagatttagtgacgatttttgggtgatgctggcagcgcccctctccgtttgaggaagcgggcaaggtagtaaccaccgtaacaaagggcgacaaacggcaccgtccagtaaagggcgacccgttgggaagggtcgaaccaaattagtaggcaagaggccaggctggctaaaaaggcgaaccaggggacgaccgggtaccaaggggtccggtacttcagcttgtcgaccgagtggcccgccgctaagaaacggcgccggtagttaagctggcaaatcgcaattgccatccaaacgatcaccaccgccagcccggagatcgaaaccaggaccaaataaatcgtgccggccgcgtaaacgctggataaaagcgataagatcccgccaagcatgctgaagataacggctaagaccgggatgccgtgggcgttggtggcggtaaagatgcgcggaatggtcccttcgttgcccagcgaccacagcatccgcgttgaagcgtacaggccggagttggccgccgaaatgatcgccgtcaagacgacgaagttcatgatgtcggcggcgtaggggatccccatcatctggaagacgtggacaaaggggctctgggtgacgccggcctgtttgtagggaatcagggccgccatcacgaccatcgagccgatgaagaagaggaccagccgccacagggtggtgtggatcgccttggggagggtcttttccgggtccttagcttcgccggccgtgatcccgatcaactcggtgccggaaaaggcgaagttgaccgtcagcatggtggtgaagaccccgccgatcccggtcggaaagaggccgtccttggtcaggttcgtcagccccggggcgttggtgtagccctggacggggatcaggccaacgattgctagcgcccccaaaacgatgaaggcgacgatcgccaagaccttgacggcggcgaaccaaaactcgctttcggcaaagatccggacggtgaagatgttggacaggagaatcaaaataatcagggccaggctccagtaccaagtcggcacgtgggggaaccattccttcatgatgatcccggcggccgtaaactccgaccccagggcgatcgtccaggttagccagtacaagagggcgaccgtaaaaccggtggccgggccgatcagttcacgggcgtaaacgtgaaaggagccggtgtaaggcatcgccaccgatagttcgcccaggcacaacatgacggcgtagaccaacacggcgccaaccgcgtaggcgatgatcgtgccgaccgggccggcctggttaatcgtgtaacccgagctcaggaagagcccggtcccgatcaccccgcccagcgagatcatctggatgtggcgggcctccatcttacgctctaagtgttcgacctcgctgcttggttcaattttcacagtgcatcatcccaatccttgtattttaattaaaaaactattacaattcgtttagtataacactagaaagccggtgcggaaatgaaacttttagaaagattagctcagggaccgctcgtcttggacggctccatgtcaacgcccctggaggttgccggggccaagaccaatagtgacctctggaccgcccaaaccttaatcgataacccggacttggtctaccaggtccacctggattacttcaaggccggtgccgatttgacgatcacggacacctatcaaaccaacgtcgacgccctggtgcgccacgggttaagtgaggaggaggcccgcaatttaatcaaacgagccgttcagctcgccaaccaggcccgggacgattacgagaaggaaaccggtaagcataactacgtcgccggttcgattgggccgtacggggcttacctggctgacgggagcgaataccggggcgattacgatttgaccgccatccagttacaaaactttcacttaccgcggctggcggccattttggcgaccggggtcgattgcctggcgctcgagacccagcctaagttgaccgaggtcgtggccatcctcgcccttttaaagacgctcgagcccacgatgccggtttacgtcagcttctcgctacgggacgccgagcacctgagcgacggaacgagcttaaaagaagcggttcaggtcgtcactaaggacccccaggtctttgccgtcggggttaactgcgttggcttagacctggtcaccccggcaatcaaggcgattaaggaggtcaccgacaagccggtgatcgtctacccgaactcgggggcgacctacgacccgaccgtcaagcagtggcgctttgaagaggggacgccccgctttgttaacgcgatcgacgactggataacggccggcgccgcaatcattggggggtgttgtaccacgctgccccaagacattgccgtggtcgccgaaaagctgcggggagtgggaaataaccggtagttaataattccaaaaaagaggctggagccacgtggctccagcctcttgctgtctcttgggtgcttagttacccttctttagtattgctctaagatccggtcaaccgccggcccgtagccctcaccaaataagattaggtgcatgcacaggtagtagaattggtagtagggcatgcgggtttgccagccctcatccagggggtaggcggcttggtatgcctggtaaaaggcctggcggaagccaccgaagatggtcgtcatcgctaggtcaaactcgcggtcaccaaagacagcgtcggggtcgatcagggtgggcgttccgtcggcggtgaacatgaagttgcccgcccagaggtcgccgtgcaacagtgaaggggtgatcgtccgttgctgacaatcggtgacaaactgggcggccatccgtttgaagtgggcgttgcgccagtcgttccaccggcccgccgcgacagccgttgctacttccggttccaagcgctggtggaggtagaagtcggcccaggaggggttaaaggagttgtccttgaccagggccttagtgtggtgattttcaaagaagccaaactggtcgtggtgcacttggtggagtctggcgacggcctggccgaggtcggcttgcgccccgtggccttcatctagccagttgaggattaaaaaggcgtcgcccttaatttggccgttaaaaagggggtgggggacgttgacggcttggcccagttgctttagcccgttaatttcgtgggcaaaataggaggctggctgctggggctgcaccttcatgaagtagttcttggtagccgtttggagccggaaggccaagttaatgtcgccaccgctgaccggttgccagctagttagtggttcggggagcggcagttggttgagccaggtttgatccattttagttcacttccttgaagtatttatctaacccgttgacgatgtctttagcgaccttggtgcggtaagtggaactggtaatctgcttgaagtcctgatcggtgttgatgtagcccatttcacacaggatcgccgggcgggtgttatcacggaggactaagaagtcactgaagtcgaccccgttgttgcgcagcggtaagttgttaaactggctgttgatggccgaggcgagcttcttgctgttgttacccttgtggtagtagtaagtggttacccccgtcccttcgtttgcgtacggcgaggagtcaaagtgaaaggagataaaggcgtcggagtggatgctctcggccgtctccgggcgggacttgaggtcgacgtagcggtcgttatcccgggttaagatgacccgcgcaccccgggcccggagctctttggccactaacttcgccaacttaagggtgtaggttttttccatgtagtaagaagaggtttcactttcgtcgtacagggccccggagtcgttgcccccgtggccggcgtcaatgacgattgtggcgttagataacttggtggccgccgtttttgcaaccgtgttttcggcctgccaggacggcacccaagcggtcttgttgttagctaggcggacctttaaccagccgttgcgcttttgcaaaatctgggactgaaaggtcttggtaactttgaccttagagtaatcaagccccgggcccttacgcacggtaaccttgctggggttgatcgacaactccccggaactaaagagcgaaccggattgggtgcccgagttggtcaacttgaagaccagggcaatggtaagaacaatgacaatgagtacggtgaggatcgcccaccgtgagtaacgtagcgttttgataatgataacctccgcagtgacaaatttgattaatgaattaaaggacccgcataagcagggcggtgagctcgtcgactgaaacagcactgaggttctgttcgatgtcgaccttactcagggcggctttaatcgcctcggcgttgtattcgacgccgaccagggccgcctcgattaggtgggggtcgccggtggtgaagaagtcaccgaagaggcggatttctgagatgtggcggttttcgatgttgaagttaaacgagaccgtgccgatcgggaagtggtgggaaacgtagtgggagaagcccgggttgtggccgtagttccactcgtcggtaccgtacaagttatccaaccgggcgtcgatggccgcccaatcctggtcggttaagtggtaggtcgggatgtctgctaggcgctcaacgccaaagaggtggcagagcaggtagtttttgaagtcctcgctggtccaagattggtattgtgcgggcaggtagggcttgatgttggtgatccgggcgtccaccgatttgattcccttggcttccaacttcccaatgtcgggagtcaaaacggtgctggcaacttcaccgttgaggtcaaacatcagggtccccccggctgcgtaagcatcgccctttttgaccatcgccatgccggagaacttcttaccgttgatagccatgtcgttgcggccccggacctcggcatccttaatccccaggtcgtggagggcgtcgacaatcggggcgccaacccgttgaaaatcacgaaagccgctagtgtcgcccacgacgatattttcaaagatgacgttgccccggtcgtggtagacggcgccaccgccgctggtccggcgcacgagttgaatttgatgttccttcatataattgaggttaacctcggcgtaggcgttttggtagcgaccaatgatgacggccgggtcgttgatataacaaatgaggccgtgcccctctaagtggaggtcgttgatcaagtaagcgtccaacgactggttaaccaaggcgttataaacgggctggccgttgcgactggtgtcaattaaaaacatcgaatccatcccctcaaatttaaaagtattatcgtaaatcttaccaccaataatggttaaaagaaggtggattttgtgaagactttaaaaaggcgcggtcaacgcttgacggcggcccggttgccgagtaaggtaagagaagtaaatttaattaagactgtcaatgaaaaagaatgatcaaccggcccgggatagcgagtgggtggtggtgcaagacccaccggtgcgctggttgagtgaccctttggagactgggcgtttgccccgctgagtattcggcgttacccacgagttgataccaaggtggtaccgtgcattttgcacccttgtcttttgcaggggtgctttttttgttgagagcctgaggaggaaacacatgcgctaccaacggccaaaagggacggccgacatcttgccaggggatagtcaaacctggcaatacgttgaaggccaagcccgccaaatttttaaaacttatggctaccaagaaattcgaacaccgctctttgaatcctacgacatcttctcccgttcggccggtgacacgtccgacgtggtgaccaaggaaatgtacgacttcaaggataagggggatcgccacatcgcactgcgcccggaaggaacggccggcgtcgtgcgggcctttgtcgaaaataagttgtacggcccggaatttaataagccttacaaggtctactacatcggaccaatgtttcgttacgaacggccgcaatcggggcgccaacgtgaattccaccagattggggtggaagcctttggggccgacaacccggccgtggacgtggaagtcatcacgatggccctgcggttctttaaaaagcttggcctctctgatttgcgggtagccgttaactccttgggggaccaggaaagccgggccaactaccgccaggcgttgatcgactacttaaagcctcactacgatgaattaagcgaagactccaaggaacggctggaaaagaacccgctgcgggtgctcgattctaaggacgaacgcgaccagcaattcgttgaaaacgccccgtcaatccttgattacttgaccccggcggccgcagaacggtttgaccaagttaaggaaatgttagacagcctggggatcgactacgtggttgacgctacgatggtccggggcttggattactacaaccacaccatctttgaagtaatggttaaggccaagtcactgggccacggctacaccaccatctgcggtgggggccgatactcaggactggtggaagaactcgggggcccggacgaacccggcgtcggcttcgggattggtctggaacggctgatcttgctgttgggcgacgaaggggtcgaactgccaacggaagacggcttagacgtttacgtggtcgggatcggcgaagcgacgaacctggagagcttccggctggtaaccgccgcccgggatgccgggctggtggccgaacgcgactacctaaaccgtaagccaaaggcccaattcaagacggcggccaaggaaggcgccaaggtaacgttgacggtcggccaacgcgaaatcgaagaggggacggtccactttaaggtgatggcaaccggtaaggaagtctccgttcccctggcagattgcttagccgactttggtaaggtttatcaagaacacgtggaggaaggttaactcatgaagcgaaccaattacgctggccgcacgagcgaagaacaaattggccaagaagttgttgttaaggggtgggtggctaagcgccgtaacctcgggggcttgatctttatcgacctgtgggaccgggaagggattgtccaactggtctttaacgaagaagaagaccaggcggcctttgaagtggctaaccaggcccgtaaccaatacattttagaggcccgcgggctggtccgcgcccgggccgaagtcaacccggacattgcgaccgggaagattgaaattgaggttaaggaagctaagatcctggccaagtcccagaccccgccgtttgaagtccaagacgacgtcgacgcctccgaagacctgcgcttgaagtaccgctacgtcgacttgcgccggccaaagatgatgaactacttgaagttacgttccaaggtaacctcaattgttcacaactactttgataataacgactttttggacgtggaaacgccggaactgacccgctcgacgccggaaggggcccgcgattacatcgtgccgtcccgggtttacccgggtcacttctacgccctgccacagtcgccgcaactcttcaagcaactcctgatggccgccggggtggacaagtactaccaaatcgctaagtgcttccgcgacgaagacctgcgtggtgaccgccaaccggaattcacccagatcgacaccgaaatgtcctttgccgaaccagaagaaattcaagcaatggccgaagggttgatcaagcgggtgatgaaagaagccgttggcgtggacgtgccgaccccgttcccgcgcatggagtggcaagaggcgatggataagtacggttccgacaagccggatacccgctttgacatgctgattcaagacgtctccgacctggttagggactcctcgtttaaggtcttttcggcaacggtggcggacggcaactttgtccgggcgatcgtggtcccggggggcgccgacaagtactctcgcaaggacatcaccaaaaaagaagattacatcaagcgttacggcgctaagggcttagcctgggtgaaggtgaccgaagagggctacaacggtccggtagccaagttcttaaatgacgacgccaacgcccttaatgaacgtttaagcgtcaaggtaggggacctggtcctcttcgtggccggctccttccacgtggtctgcgactccttgggttacctgcgtgaaagcatcgccaaggaactggacttgattgacgaaaacaagttcaactacctctgggtaatcaactggccgatgtttgaatacgacgaaggctttggtaagtggatcgccgctcaccacccgttcacgatgttaaacgaagacgacctcaagtacttagaagagggcgaggacccgcaccaggcccacgcccaatcctacgacatcgtcttaaacgggaacgaaatcggtggtggctcaatccgtatccacgacccagaagtgcaagaaaaggtcttcaaggccctcggttacaccaaggaagccgcccaggcccgctttggcttcttgattaaggccttagaaaacgggatgccgccagaaggtgggatggcctttgggctcgaccgttgggtaatgctgttggcccacgccgactcgatccgcgatgtgatcgccttcccaaagaactccaaggccgttgaaccgctgaccgctgccccgggcacggttgacgatgaacaactggaggtcttgcacctaaacgttgaagaggcgccaaaggaagtcgaataaccaaactagtaatagtagaaatagccgcgggtgccgtttgaaacgacgcctgacggctatttttggctctttgtcaaatcctgttgatgggtcattttaggcggcggccggtgcttgcacctggcgccgccttttttctgcttccgttcccatttgatgcaatcggatccgggcgatgaaatgaccaaagttagtaaagccatatgccgtccgttgaattaacttgatcatgcggttgatcccctcaacccgaccgtttgagtacggtaatacggttgcgttgtacactccttcgctgttcttacggagggtcttaagaaccgtttggaacggcgctggcatgtcccatttggtgaacaagaggtccattaattggtcaacatcgtgctcttcaagagcggtcatggcgccctgtaagagttcataaccggccgctaactggggatcaaggtccaggccaattcccacccgttcggccatcgttaccttttgtcgtaagtggcgatcatagtactccttagtgtagttaagcgatgtgcttttaagtaagtacagtcgccacgaattcttcaatgcccgatactcacgcgtattagggtcgaattgcttcattactgcgacccggacttggttaaacgcccgcgtaagcattgaaacgatgtggaatcgatccacaaccagctttgcgtttgggaagtagcggcgtacaaggccttgatagtaactgtttaagtctgtcgagactgatttgactcgtttgcgctcttttagcgagaatcgatcaaagtaatgcgtaatactactcttaagccgatcagggagaatttggtagatttgtgaggtatcattatcaacgataatgaagcaatacttcccctgcggaccacggaactcatcaatggcaatattagtgggtaaagtgcgactattaaagcgaaggagcgcttgatcactgtctaggagtcggccaatggtactaggtgacacaccggtaaacttagacacgtccttttgagagacattactttcaagcatcgtaagtgccttgtgtttaactgctttggcaatggaacagtatttatcaacgacgttggtcttcgccatgaacgaatcttggcaattcttacatctcaggcgttgcttaccgatccgcaacatagtgggacaactttcgttaattgagagatacttaatggtttggtaagaatggccattcttaatgaaggtattcgcaaagccgcaatgtgggcaccgatccaatttaagcgagaccgtcccaaggaagacctgcgtctcccatccgtcattattttcaaagacaacgtctgtgaaatgaagattggggtctttaatttgaaggatatttttaatataatcagtcataaggtcacacctcttactttctggaatttgcgtggtagttaatgatcagaattttaaggctggtggggcctttttttgtgccctcaaaaccaaaaaatcctgtcaacgaattaccactatggtaatccatcaacaagatttagtgtagagccctattttttggctggtccgcacttccgataacgtgcgtgctcctaaccacgggtctagtggctaagtacgggcaaagaacggcgctggggcgccaactatttaccctatcttagcccaacgacccgtcaaggaggttagtcgcacttccatctcaaaccgcacaggaaaaatctatcaatttggcgtgtctcaaatgagggattatgaaaagattaacgttgggcaacaactccttttgctctgtgtccgaaccttactacggcctgcttgatggttggtccgcacttctttcttttagttaattccctagtggcaccgtgacggggcggtgagtataatggagaaaactttatccggaggaacgcacatgcgacttaacgttttacaacacgtcagtgacgaaggaccgggggccatcttaaattgggccaacgaccaccaagcgaccgttaccatctaccaccccaacgactttggcctgttgccaaccgttgatgaaaccgacctgttagttgttttgggcagcccagctagccccaacgatgacgaccaatggatcaaagacgaacgggccctgatcaagggaatgctaacggcgaagaagccggtcttcggggcctgctttggcgcccaacaaatctcgctaattttgggcgggcgggttcaagacgccccggctaaagaagtcggttggctagaagtgacccgccaaagcgaccggatcgccggtctgccggaggttgccacgccactgcactggcaccagcagatgttcacgatcccagaaggggcggacctgctttattcgtccaagtacctgcaggaacagggctttgtctaccaggacctggcgattggcctgcagtttcacttggagcccttagaattgaacgtacgggaaatgtgcgctaacgacggggcctacgctaacgggtcagttttaaaccagactgcggaagaaatcgtcaaccacggggttccggcggacaaccaggccgtcatgaaccggctgttggactacttgatgaaagaaaatcctgaaaacgtctaaaaaattgattgacggtgaattagtgcttgtttataatggtcattgtagtggaaaggccaggagaacttggtcatgacagtacgatcttaagctcggagggagggaattttacaatgtcaaaaaccatcgttcgtaagaatgaatcgttagacgatgctcttcggcgctttaagcgtaccgtttcacgtaacgggactctgcaagaataccgcaagcgtgaattttacgaaaagccaagtgttaagcgtaagttaaagtctgaagcggcacggaagcgcaagaacaagcgccatcgttactagtcgcgaaaagctcccgccggtttctggcgggagttttttcttacataaaatgggggtattgatgatgagcttattacaacaactttccaaggacatggtcaccgccatgaaggaaaaggataaggcgaccctgtcggtggtccggatgttaaaggcggccgtgcaaaacgaacagatcgccgtgggccacgatttgacgccggacgaagaaaacgccgtcttggcccgggaatacaagcaacgcaaggaatcgctggaagaatttaccagcgccgggcgccaggacttgattgaccaaaccaaccacgaattagcggtggtcgctaagtacatgccggaacaaatgtcggctgacgaagtggctaaggtcgttaacaaaacgattacccaggtcggggccgaaagcatgaaggactttggtaaggtgatgggcgccatcatgccaaaggtgaagggcaaggccgacgggaagttagttaaccaaaccgtcaaggacgctttgcaagccaagtaacaactagagagggggccgcgcatttgaccaggttggtcgtgccagggcccctttagtttcggccaaaatcttgcatccaagcgcttggccgcggtaaaattaaggaaatgatttgcgccgcttggcgttgtaaaggagaatccgtttttgagcgaaaacgaaactttggccgttaactttcaaattgacagcccggaaattgaagtggccctcttggggacccaagataagtacgtcgccctactagaagaggggatgaacgtttcgatcaacccctttggcaatcagctgcggatccagggggacgccgaggacgttcacctgaccgaggcggtattaaaccaactggtgggactaattgaacaaaagattcagatctcgtcaaccgacatagtctcggcgatgaagatggcccaccgggggacccttgagtatttcaaggacctctattcggaaacgatcatcaacgaccgtaaggggcaggccatccgggtgaaaaactttggtcaacgccagtacgttcacgccatgaagaaaaatgacattacctttgggatcgggccagccgggaccgggaagacttacctggccgtggccatggccgtggcggccctcaagcggggggaagtggaacggattatcctgacccggccagcggtggaagccggcgaaagcctcggtttcttgccgggggacctcaaggaaaaggtcgacccctacctgcggccaatttacgacgccttaaattcgatttttggggccgaacacaccgaacgcctaatggaccgggggacgattgaaattgcccccctggcctacatgcgcgggcggaccttagacaacgcctttgtaattttagacgaagcgcaaaacaccactaacgcccagatgaagatgttcttgacccggttgggctttggttctaagatggtcgtcaacggtgacgtctcccaaatcgacctgccgcgcggggctaagagtggcttgattgccgcccggcggatcctgcggggcgtttcttcgatcgagtttgttacctttggggcggccgacgtggtgcgtcacccagttgtcgctaagatcattaccgcctacgaagaagatgaagaacaggtgcgggagaataagtaatggaattacagttgcgtgatcataccgaaggaaagttacaacccagtcaagaacggctagcggagaaggtcttggcccaagcagcggagcgactagacgtccccgagcaagccgaaatgtcattgacctttgttttaaaccccgagatcagggagctcaaccgtgattaccgcgggattgaccgggcgaccgacgtaatttcctttgcgattgaagacgacgatgacctcgccaacctgcctgcagaaatccgcgctgagctccccgttgaactaggcgacctggtcatttcaattgataaggtgaccgaacaggccctctttttgaaccattcggcagaccgcgagctgggctacttactggtccacggcttcttgcacttgaacggctacgatcacgaggagccggcggatgaggaaaagatgttcacccttcaggaggagattttagatggcctcggactcagccggtaagcaaaccgaaaaaaaccacaccttcgcccaatcattacgccatgcttgggcgggcgtttgccaagtacttaaacaagagcgcaacatgcgtttccacctggtggcggccgtgctcgccgtgatttgcggctggtggttgcacatttcaaccgtggaatggctgtggctggcgttagcgatcttcacggtcatctcagcggagttcaccaacacggtggtggaggccctcgttgacctgattgtgcgccaccacttcgatctaaacgccaagcacgctaaggacgtcgcggcgggggcggtgttgtgtgccgcctcctttgccgtggtggttggcctcttaatctttgtcccccacctattaaaactactgaattagaaacgaggatcaaatggataatccaaattacaagtcgggctttgtggccctgatcggccggcccaacgtcggcaagtcaaccctgttaaactacatggtcggccaaaaggtggccatcatgagcaacgtcgcccagaccacccggaacaagattcaggggatctacactagcgatgaggcccagatcgtcttcatcgataccccggggattcacaagccccaaacccgcctgggcgactttatggaacgctcggccctgtcggccttagatgaagtcgacgccattctcttcgtggtaccggccaatgaaaagcggggggccggggataacttcatcattgagcgcttaaagaaggtgcaacagccgatctacctggtcgtcaacaagatcgaccaggttaaccccaacgacttaccggacatcatcgcccaatacgaaggggcgctgccgttcaaaaaggtcgtgccggtctcggccttgcagggaaacaacgtcaacaccctgattaacgacttagtggaccaactgccgaccggcccgcagtactacccagccgaccaggtgtccgaccacccggaacggttcgtgattgcggaaatgattcgcgaaaaggtcttcttaaataccagggaggaagtgccgcactcggtggcgattgacgtcacctcgatccaacgagaagacgatgaaacgattcacgtctcggccaacattatcgttgaacgccccggccaaaaggggatcatcatcggcaagggcggttcgatgctcaaaaagatcggcaccgcggcccgccaagacattcaggccctcttaggtgacaaggtcttcttgcagctgtgggtcaaggtggtgccgggctggcgcgataaatcggcgatgttaaaggactacggttaccggcaaacggattactaattgtattcgaaaatgttagacagataacgtgggaaataaccgcgggcctagtgtctaagcacggcctggcaaagaggttatttcccacccacttttttaagggggaattcagatggcccgggtcaacgaaccctttgaaggggtgatcatgtaccggcgcgactaccgggaacgcgacctcctggttaagattttgacggaccggcgcggcccgctgatgttttttgtccgcggggccaaacgcaagggctttaagttggcgtcagacattttacccttcacctacggcagctacgtggggatccttgccgacgagggcttgtcttacatcgtctcggcccaaggaacccaccacctaaccgggatcggcgccgatttaaaccgcaacgcctacgcgacttacctgctagaactggtcgaccaggcctttgaagaggggcgggcgctgggcggctggtacaagcaggtgatggcggccctaaacttgatcaacacggggcgcgacccccaggtagtcgtgaacgtgttggaggtccaactcctcaaccggttcgggatcgccccggtctgggaccggtgcgtggtgtgcgggcgcagtgatttgccgctggattactcggaaaagatgggcgggatgctgtgcctccatcactttgcagaggacccctaccgcttccacctcacccccaaaaccgtcgcctacctccggctgtttgcaacccttaacctggccaaggtcgatcaggtacacgtagacgaggcgaccaagcgtcaattaggccggacgctggacaaaatctacgacgaccagttgggcttgcgccttaagtccaagcgcttcatcaacgaaatggattcctggaccaaccggctcttgaccgccagaaagaatccggggacggacgacgaaaaaaagccggccgggagttgacttttctaggtgacgttcgtatcattaaaaagtgttaattaaagatctgcaacgatgacggaaaagatggttcagccgtccatgaagcgaccgggggagggtgcaagccccgggggacgtgaacctggtggcactcccgagttgccttaacgaagctgtcccacctctctgggaaagcagggtggaaccgcgaagttattcgtccctgcaatgaccggttaaaccggtgattgtgggggcgtttttgcgtttgaaaggagtaagacaatggtaaagaatctgagtgttcaagagattatcttcacgcttcaaaagtactgggcgagccagggttgcatgctgatgcagtcctacgacacggaaaagggggccgggacgatgagtccgtataccttcttgcgggcaattggtcccgaaccgtggaacgtggcctacgtggaaccgtcccggcggccggccgacgggcgctacggggaaaacccgaaccggttataccaacaccaccagttccaagtactgatgaagccgagcccggaaaacatccaagaactttacttgggctccctgcgtgaattggggattgaacccttagaacacgacattcgtttcgtcgaagataactgggaaaacccgtcgatgggttgtgccggagtcggttgggaagtgtggttagacgggatggaagtcacccagttcacctacttccaagtcgtcggtgaattacaaatggacccggttgcctccgaaattacctacgggttggaacgcttagccgaatacattcaaaacgtcaactccgtcttcgacctggaatgggccgacggcgttttgtacggtgacatcttccaagaaccggaatacgaacactccaagtactcttttgaagaaagcaaccaggacatgctcttgcaattcttcaaggattacgaacaagaagccaagcgcttaattgacctcggtctggtgcacccggcttacgactacgtcctcaagtgcagccacaccttcaacctgctggacgcgcggggtgccgtttcggttaccgaacgggccggctacttgcaccggatccggatcatggctaagtcggtcgccaaggccttcgtcgaagaacggcgtaagttaggcttcccgctgattcacgacgaacaggaacgccaagccgtcgtggctaagtacaccaagcaagccgaagaactggccaagcgcaacgctaagcgggcagagaagggagaaaactaatggcacattcatacctactagaagtcggcctggaagaaatgccggcccacgtggttaccccaagcatccaacaattaaagacccgggtggccaactacttaacagaagaacggatcgactttgaagacattcaagcctactcaacgccgcggcggttagccctgttgatttctggtttggccgacaagcaacccgacgtcgatgaatcggtgaagggaccagccaaaaagattgcccaagacgccgatgggaactggaccaaggcggcaattggttttacccgcggtcagggggccacggttgacgacatcgaatttaaagaagttaagggcgtcgaatacgtttacgtcgaaaagcacatccaaggcaagccagtcgccgaagtcttggccggtttaaacgacgtaatcacggcgatgaacttcccaaccttgatgcggtgggggagttttaagctcaactttatccgcccaattcactggctggtttccttgctcgatgaccaagtggtaccctttgacattctgaacgtcacggcgggccgtttaacccgtgggcaccgtttcttgggccacgacgttgaaatcaagtccgccaccgattacgtggccgccttaaaggacgacttcgtgattgtcgacgcggccgaacgcaaggcgacgatcaaggaccagatccaagcaattgtcgaccaacacaactgggtgatcgactgggacgaagaactcttagaagaagttaacaacctggtggaatggccgaccgcctttgccgggacctttgaccaaaagtacctggaattaccggaaccggttctgatcacgtcaatgaaggataaccaacgcttcttctgtgtacgcgaccacgacgggaagctgcaaccggcctttatttcggtccgtaatgggaacgccgtccacttagataacgtcattaaggggaacgaacgggtgttggtaccacggctagaagacgccaagttcttctttgacgaagaccaaaagatgacgatcgaccagtacgtcgaccgcttgaagaacgtttctttccacgaccaaatttcgtcgatgtacgacaagatggcccgcaccaaggccctggctaacctcttagggcaacaactaggcttaagcgaccaagaactggccgacctcgcccgggccgcttcgatttacaagtttgacctgaccacccaaatggtcggcgaatttgccgaattgcaagggatcatgggggaaatctacgctaagcgctttggcgaaaacgaggccgtcgccgccgccgtgcgcgaacactacatgccaatttccgccgacggggccctgccacaaacgacggtcggggcggtcttggcgattgccgacaagctggactcaatttactccttctttgccgtagacatgatcccgtccggttccaacgacccgtacgccctgcgccgtcaggcctacggaatcgtgcggatgctggcggaccgtaagtggcacttgaacttgcttgatttccaagcgagtgccaagcaagcggtggaacaagcaacgccagccctgggccttgattacgctaagaatgcggacgccgtgaccgacttcttcatcgaccggctcaagcagctctttagcttataccacttgcgccacgacattgtcgacgccgtcaccgacacccacgtgaccgacccggccgccatcgtggaagccgctcacgtcttagatgcccacaaggacgacgcggacttaaaggaccaagtggaagccctgacccgggtgatccgcctggccgccaagggaaacctgtctgaagacgacgtcaaggtggacccaagcctctttgaaaacccatcggaaggccagctagatcaagcggttcaagccctgattgatgccaaggaaggccggagtttggatcaacagttcagcgccctgctcgaattggaaccagtcatctcgctctactttgaagagaacatgatcatggacaaggacgaagcggttaagaacaaccgcctctccttattgacgatcttggcggaccaaacggcggcctttgggaacttagaccaattgattgttaagtaggcaatccagttggcccaccactaaaattatggtattatgataactagtaaaagtgggccccaaacaatttaatgtcgtttaattcgaaaggtcgcattccaacgggaaggcgacctttcgtaactatcgctagcgagagggggaatggtggatgccccaaatcccaagggaaacgatcgatcagctacgcaaccaagtggacattgccgacgtcattagccaagacatccagctcaaaaagcaggggaaaaacctgatggggcactgtccctttcacgaggatgccaccccgtctttttcggtcaacgaagaaaaacagtatttttattgtttctcctgtcaccgcagcggggacgtctttagctacttggagcaggcccacgacctctccttcatggaggccgtcgaacaggtagccacgacggcgggggttgacttgccaagggaaagtaacggcccgagcggggaaagcgactctcccaacaccccgctttaccgcttacacgaagaggccagtcgcctttaccaccacgttttagttaacaccgtggcgggacagccggccctcaattacctaaccaagcgggggatgagccgggagttaatcggccagtttaacctcggttttgcccccgcccggggggaagaggacctcttggtcaagtacttcacccaaaaggggatcgattaccagctcatgcgggcctcgggcttatttaccgaggaccaaaccgggcagttgcacgaccgtttctttgaccgggtgatttacccaatcaaaaacgccaacgggcaaccaatcgccttttccgggcgcttattgactaaaaaggcgaccgaaaacgcccctaagtacttaaacagcccggagacgccgatctttaataaacggcggaccctctttaacctggaccaagccaaaaaggcggccagaaaggagggacacctaaccctcttcgaaggcttcatggacgtgatctcggcctttggggcgggggtccggtcggggattgcctcgatggggacttcctttaccgacgagcaggtggccgtgattgcccgcaccaccgataagctgacgatttgctacgacggggatgccgccgggcaaaacgccatcaaccgggcgctgacgatgctggcggccagccggttaaccctgcgcgtggtccagttaccggccggtatggacccggatgagtacgtccaagctaatggtcaagccaagtttcaagagtacctcgcccacgccgaggagacgccgaccgcctttcggcttcactttttaaagcaggggcttaacctagccaaccaaagtgagctcttgcactacgttgaagccgccttgcgggaggttgctaaggtcactgatccggtggaacgggacctctacattcaacagctggcgaaggattaccacttaaatcccgccactttgaccgggcaggtgcaggaactagcggcgaccgcggcgccacgcccggcttacccggagaactcccctcgtcagccgcggcaagcagggacgcggcgttatcaatccacgccccccaccacaactaccgcgccgagtacccaggcgccaccgctgttggggaaggtcgaattggctcagcaacggctcctgcgggagatgtttcataatcccgccgtccgcagccacgtgggggcgattgaaaacttccactttgtcgatcgcccttaccagctccttgacgcggccgccaaggagcagttgcaaaggaccggggccgacgaggtggacgtcgcccagttaatgggggagctgaccgacgctaagctcaggacgatcgttggccagatcgagcaacgggtggtgccacaagcggcggtggatgagaccgtcgacgattgccttgccgtgctcgtcgacgtcgccccgattgaacaacaaataagagagaaaacggccgcccttcaggaggctgccgccttaaacgatcaacaattgatcaccaagctgacgatcgagttgattgacttgcggcgacaggaacagaagatgaaaacggaggatgttaattaatggcaaagagcagtaagaagaaccgggtaatttcgaacttagaagatttcaaccaagccgaatacgacaaggccgtcggggctttgattcgcaattacaagaaggcaaaaaacatccagtacgatgaattaaccgaaaagattgccgaaccgtttggcttaaacgccgacgggatggacgccctgttgcaaaacgtggaagacgccggggtttccgtggttgacgaaaacggtgacccggacctgcgggcactcaaggcaaccgaaaagctgtcctccaaggccttaaaggataccaccgctccgtctagcattaagatcaacgatccggtgcggatgtacctcaaggaaatcggccgggtcaacctgctgacggccgacgaagaagtggcgttggccctgcggatcgaaaagggtgacgaaaccgctaagcaagaactggccgaagccaacttgcggctggtggtttcgattgctaagcgttacgtgggtcggggaatgcagttcttagacctaatccaagaggggaacatggggctgatgaaggcggtcgaaaagttcgactaccgtaagggcttcaagttctccacttacgccacctggtggattcgccaggcgatcacccgggcgattgccgaccaggcccggacgatccggattccggtccacatggttgaaacaatcaacaagttaatccggatccaacgccaactcctccaagacctcggccgggaaccgctgccggaagaaatcggggccgaaatggacatggacacccaaaaggtgcgtgacatcctgaagatctcccaggaaccggtctccttggaaacgccgatcggtgaagaagatgactcccacttaggggactttatcgaagaccatgacgccaccagtccggccgaccacgccgcttacgagatgatgaaaaagcagctcgaaaacgtgctggacaccctgaccgaccgggaagaaaacgtcttacgcctgcgctttggtttggacgacggccggacgcggaccctggaagaagtgggacgcgtctttggcgtgacccgggaacggatccggcaaatcgaagctaaggccctgcgcaagttgcgccacccatcccgttccaagcagttaaaggacttcttggaataaagggaagtgggcaccaacccctggtgtagctcggatgacgaggctagggcgaacggctagctcccacgtttgctagcgtaaaaaaaaggcgacccaggaaaaccattcggtttcctgggtcgcctttttttgaggagtgtatttgagtgggtggcttagctcagtactaagcccccgtttggtgaaataacctgcccggttaggtagccggcggtcagaatgtaaccgagggccccggcgatgtccttgacgtcaccgataaagccttctgggatcgtggcggccagggcgtttaattcgtcctggttaacgccgcgcaacatgtcggtcatgatcatccccggggcaatcgcgttgacgcgaaccccttgcttagcaaattcgagggctaaggcccgggtcaaaccgatgatcccggacttggaggcacagtagtcggcttggttgatcaccccggtcagcccccccacggaactggtggagacgatgttgcattggtgatccttgtcggcgtggttgaccatgtacggtaagaccaggtgggtcatgtgcagggcactcatcaggttgaccccgatcagcttttcgtaggcgtggtggtcaacgtcaacccagttggagttgttggtcaccccggcgttgttaacgagggcgtcgatcttgtcaccgaagtgctgaacggcttcatcgaccaggtgctggcatgaatcgaagtcggccacgttggcttgcaccaggaaggtttcgacgccgtacttttcgctcacggcatcggcaacttcttgggccttggccttggagtggtcgctgttgtagttaatgacgatgttgtagttgagttcccccaacttatcaaccatggctgccccgatcccacgggacccaccagtgatgatggcaactttacgttcagacataagcatccctctttcgttgataaatctattgttactatatttaaaatataaaccgatttttaaaaaagcgcaatcatctctaacagctcagcgtcctgacggttggcgttttaagcttgctaagagggcgaagtccaaaagggcgatggcgaccgtgaagcaaaagaggacgatgaaggccaaccggctcccgcttaaaactgcggtggcgccgttttgaatcccggcccccccgatggcgataatcacggccatggcggcggtgccgattgaaccggcgtattgttgaagcatgttaaacaaggcgttgccgtcgccaatctggggcccgtttagctgctggagccccagcgtcatcgtgttgttgtacatcatcgaaaagcccagcatgtagaggacgtggaaggcgatgatggttaagatggtcaagtgggcaatgaagacggtgaataaaatcaggctggccatgatgcacaggctcccggcaatgagggggaagcgtggcccgcggtcgtctaagagccgccccatgacgggccctaaaaacgaggataagaggcttccggctagcaacaagaagccggcgaccagggcgctttggttaaaagtcaactgggcgagattcgggattacgaaggttaaactaatttgcaccagttgtaagaagacgtagatcaacaggctgtaagtgaaggcgtggttggttaaaatccgtaagtttaagaggtggtggcccccagcgcggcgagtgagcactacaaaggcgaccagggcggccaagaaaagaagcaggcccccggaaacgagcgggtcccccagcccggcgtctagttggttgacggcaagggtgagggccactaagctaactacgatggcgaggtattcggcgagctggaagcggtagcgttccggcttatttttaattgcgtttttgatcgcgacccagctaaagatggcgatcaagggcagggtaaagatgaagttatagcgccagtcgagcaggtcgagcaccgttcccccgtaggttggccccaaagagggggcgagggcgatgatcatccccgccgtgccgacgtaggtcccttgttgctgacggggaacctgggtcatgatgatcgtaaacaagaggggcagcgccatcccggttcccgccccctggatcacccgcccgagcaggatcattggcgagttgagggccacagcgcagatgaccccgccgaaaaaggacgccaggaccgaaacggttaaaatggtccggtagtgaaagctgcgttgcaagtaggcggccaggacaatcgtcaaggtgaccgctagtaagtaggcggtcgtaatccactggacgttgttgagcgtggtgtggaagagtcccatcagggtcgggaaggtgacgttcatcgacgtttcgaccaggatgccgcaaaaggcgaggccggcaatcccggcaatttccgttttaacttggcggctcacggttgactttggttgtataaaaaaacctccaattctgcggtaaagcccacctgtgtttccacaaacgaacttcgaccagaattagagggaaccccatattatacattctagcgatagagctctagctttaccgacttgtaagatattaatgacattatagcatagttaggggcgagtggtgtggtattatttagggtaacaagaacggagggattggcatgcaagcaggaagaacggttcacttgatggggacggtgattacgttggtgatcaacggtggccccaacgccgggaccctcgccgaccaggtggttgaacaattaagggcggcggagcaccgtttttcggccaacgatgagtcggcggacctgatgaagatcaacgcgagtgccgggcaggggccagtcgaagcggcgccggacctttatcaattaattaagcttggcgtccactacagcaagtaccccgggggcaacctcaacgtagcgattggccccctggtcaagctgtggcacatcggctttcaagacgcccgggtgcccagccaagcggagattgactgggcccttgctttgaccgacccgcgccaaatcaccctggacgacgttacccactcggtcagcctcaaccgaccgggcatggagattgacttaggggcgttggccaagggttttatcggggaccaggtgatcgcctggctcaaggaacagggggtcgaatcggccctgttaaacctcggtgggtcaacggtgattggcctgggcggcaacacggagaatgaagacgggatgtggcacgtcgggattcaaaacccggctgacccggcccaagcttacggccaggtggtttcgatcaaggaccaggccctgaccacttcgggggtcgccgagcgcaagttgaccaccaacgggaaaacctaccatcacatcctaaacccccagaccggctacccggacgagacgacggtggtttcaatgtccttggtgacgccgaccgcctttttaggggaactgtggacgacgatgctgtttggcaaaaccaaggagcagatcgccgctgtcgtcaaaaccctcgagcagaccgtcggggtgttgattgaagacgacggcaccgttattcagttgcggtaaggggaagagagtgggaaataacctccttggcaggtcgtatgactaagctagggcgaacggttggtgcggtacgcaccgttcttcggcattaggcctgcggttatttaccacattttctgtctaacatttgagtatacagtaagaggctggaaaagcagattttccagcctcttttattttagttggttaagggatttccctcctacttgcttttaacggcgctgacctggggcaggctcgcgacgaagtctaagtaggcggcctgctcgccggtttcggtcacggtgacgtctgcatcggtgacctgggcgtcgtggagggcggcctcgtggacttcaatttggtgggtgaaagtggcgttaccgattaagtcaatcgtgtaacgggcgtcatggtggtggaggatcgtcttgaccatgccaccggggttgtaaacggtgatcggggtctcaaagccagcctggtcgggatgggttagggcgaaggccagggtcgtcgccgacatcccggtcccgcaggcgttggtgaagccgaccccgcgctcataggtccggacgaagagttcgttgggaccaaggatgtgggcgaagttgacgttgaccccgtctgcaaagtaggggttctccccgttgaggcgttggcccagttcccccaataccggcccggcgagttcttcgtcgctgacaaaggcgatcaggtggggattgggcaccgccagggcggagaagcgccagccgggcacaaactctggcaccagggtgtctaaaagccgttcgtggccaacctggtcaaatggaagggcctccttgttaaaacggaccggtgaaatttcgacggcgtagcccggcacgccggggaagaagtcgtcgtggtaggccacggtcaggtcggccttcatcgtttcgacttggaagcgggtctggttagttttttcggccaggtagcgggcgacggtgcgcaggccgttgccacacatcgaggcttcagatccgtcggcgttgatcacccgcatttggtcgctggcggccgggttgtcgctgtcgttaaccacgagcaagccatcggccccacctaaaattccggtagctggatcgcataattgaaggcccagcgctcttagttccgggtcggaaagcgggcgggcaagggtggtttggtcgagtaagaagaattggttttgtgatccgtgaacctttagtaactgtgccatggtttcctcctgttagtgaataaagaagcggtcgtagatggccttgacggttttgtcggcgtccttggcccgggtgccgatcataattgagatttgggaagccccctggttgatcatcggcacttcgacgtgggcttctgctaggggcgccaagacgtcctcaatcacgccgaggctggtccgcattccttcgcccacgatcatcgtgatggcgtaatcggggatccatttgagttggtcggggttaatttcgcattggatctcgttgcagaccaaatcgatttgctcgtcggaaatttggttgcggttgatgatcacggtcacgtcgtcgattccggatggcatgtgctcgtaagaaatcccgtggcgctgcaagatcgaaagcaagcggagggtgaagccattttccttgttgatcaagtacttgtgcagatagagggcggcaaagtgggcgcccccagcgatcccggtgatgatgtcctctggcttaaagcccttttccggtacgatcatcgttcccggcttttgcggggcgttggtgtttttaacgttaatcggcacctggccttgaattgccggaatcaaggcctcgtcttgaaagaccgaaaagccggcgtaggaaagttcccgcatctcccggtaggtcatctgacgaattggctgcgggttgtccacgatgttggggttagcggtgtaaatggcgtccacgtcggtgaagttttcgtataagcgggcccgcagaccgcaagctaggatcgccccggtcgtgtcggaaccgccgcgggcaaaggtcgcaatccggccggccggcgtgaagccgaaaaagcctgggaagacgaggcgctggttgggatcgtacttaaaggcgtgcaagttgccgtaagtgtgtggactaacggtagcgtcgttgggcgtcccggtcacctcaaggccacactcgctggggtcaacgaagcgggcgggcatccccacgtgggtcagcaccaacgccattaagcgggcgttgaggcgctcaccgtgggccttgaaggcggccattaggtaatcttggttgggatagtcttgcttgggtaagtcctctagggccgcttgcagcggggtgagggccacggcgggtaaaccgaagtgagtcgcgatttccgaatagcggccgaggatttccttaacggtggccgtggcgtcttcgccttggcaaacctggttagcgtaacgaatcaaaaggtcggttaccttaatgtcgccctgaaaccgtttccccggggcggaggtgacaatcaccgtccgttcgggatcgtcttgaataatcttaacgaccttttcgtaggccgctccgtcggcgagggaagttcccccaaattttacaaccttcataaaaatactccttttgccagtttagggcgttaatttttaattggattttaacacggctcctaattgacgcaagtcctaaatctttttgcaatcttcgctaatacggctttaggcacggtttatcaaggggtgaaagtatttatgggtgagaataaaattaaaaagccttgacggcaggggtaaataattataaactaccaataaattgaagaggcgcaaccaacatgagtagctaccaagagccgggtcaggcaaggagggggagtgaaaggggcggttgccgaagcacggggaagtgaccgttccctggggctggggcgtggcttaagaggctgcggactgtcgcgggacaatgagagcctgcggtgcgctatcaattacggctgaataaaccaccccgggtggttgggctctggatgcgcaccgcacccagagccttttttcataccgataaagaaacggggaactaagatgaattcacagattgaaccagaacagattaacgatcaggggcacctaacgattggcggcgttgacagccttgaattagcggccaagtaccaaacgcccctggtcgtgtacgacgtagcggcgattcgccatcaaatccgcgcctttaaaaaggtctttgccaaaaaccaggtggcagcggaggtctcttacgccagcaaggcctttagcgccatcgccatttaccaggtggtggcccaagaggatggccacattgacgtggtctccggtggcgaattaacaacggccatcaaggcgcacttcccgatggaaaaggttagtttccacggtaacaacaagtctaaagaagagctggaattggccgtccaaaacggggtcgggatgatcatcatcgataacttccacgagatcgacttgctgggcgaggtcttagatgaacaagacgccactgcgaccgttagcctgcggatcacccccgggattgccgcccacaccaatgagtacattcaaaccggccaggtagattccaagtttggctttgacctggaatcggggcaagcggaccgggccctagaagaggtcttggccaacccccggctcaaggtggtcggcctccacgcccacatcggctcccaaatctttgaggtcgtgggctttgaaggggtggccaagaagttagtggacgtcgccgagcactggcacgaggagtttggctttcaaacgcgggtcttaaacgtcggcggtggctttggaatccgctacgttcaagaagaccaaccgctcccgccggaagaatttgtcgatgcaatcatcaaggccgttaaaaaggaggtcgccaaaaagggcctgtcaatgccggcgatttggattgagccggggcgctcgatcgttggaccggccggctacagcctgtacacggttggttcacgaaaagacctcccgggctaccagcccttcgtgaccgttgacggtgggatgggggacaacatccgcccggccctttaccaggccgcttacgaaacggtgtacgctaaagacccccgtcaaaaaccggaagagaccgtcaggattgccggtaagtattgcgaatccggcgacatcttagcaagggatcaggccctccccaaaaccaagccgggcgacctcttggtagtgctagacaccggagcgtacgggtacgcgatggcctctaactacaaccggaacccccgcccggcggtggtcttcgttgaaaacggccacgctcaactggtcatccaacgcgaaagctgggcggatacctgccggctcgacttaccgctcgcaagtgaagataaataataggaagaaaaaggagaaattcacatggcacaattagacgcgcaagcaatcattaactacatcggtaccgcgcccaagaagacccccgttaaggtctacgttaaggggactgacttaaaagcacttacgtttcccgctgaagtagaggccttcgtggaacaaactaccggggtcctgtttggcgactggcaggtcttaaagcccttcttagccaagcacgaagcggactttgcggcggtccgggtggaaaatgcggcccgtaattccgccgtaccgttgctggacctaaaggaagttaacgcccggattgaaccgggggccacgattcgcgaccaggttttaattggcgataacgcggtcatcatgatgggcgccgtcatcaacatcggggccgaaatcggggagggaaccatgatcgacatgggggcaatcctcggtggccgcgccctggtcggtaagcactgccacatcggtgccggaaccgttttggcgggggtggttgaaccggcgtcggccaaaccagtccggattgatgacgacgtgctgatcggggccaacgcggtcgtgatcgaaggagttcacgtcggggaaggggccgtggtggccgccggggcggtcgtgacccaagacgtagcgccgcacacggtggtggccggggtgcccgcccgctacattaaggacgttgacgaacagaccgattccaagaccgggctggaagacgatttgaggaagctctaatgttaggcacggaggagttaattcagattcgccgccacttacaccagattcccgaactagccctacaggaaactgagacccacgcctacctaatggaggtgatcgggaagatggagcaagatcacctggaaatcttggaaccggaggacttgccgaccgccattttggtccgggtgaacggtacggcgcccgtccgaacgattggttaccgcaccgatattgacgccctaccggttcaagaggagaccggcttaccctacgcctctacccactccggggtgatgcacgcctgcggccacgacgtccacatgaccgtggcgctgggggtcttggactactttgccagccaccaacccaaggataacctgctctttttcttccaaccggccgaagagagtgaggcggggggccagcgggcctatgagctggggctatttgaaggtaagtggcgccccgacgaattttacggtctgcacgataacccggctttgaaaaccggggtgattggctgccggctggggaccctgtttgccgggacgaccgaagttgacattgacgtcttaggtaaggacggccacgccgccttcccccaggaggccaacgacgcggtggtggccgccgcggccctaatcatgcaggtgcaaacgattatctctcgttcgattaacccggttgaagccggggtgatcaccctgggtaagttagaggccggaaccatccgcaacgtaattgccggccacgcccggatcgaagggacgattcgcgggttgacccaggaaatgatcgaaacgattgaccgacgcctgcaagacgtctgtgaggggattgccaagagttttggcgttacggtcaacttggccctgaaccagggcggttacttgccggttgaaaacgaccccgccctgaccaaacgtttcattaacttcatgcaaaacaacccggccgttgactacgtggaaacggcgccggcgatgaccggggaggactttggctacttattgtccaagttccccgggacgatgttttggctgggggttgaagacgatgcccagcttcaccaagccactctgacccccaatgaaggggcgattcaaaagggaattgatgcgctaaccagctttatcacctaccgcagccaagcagaggaggactaatcatgacagaacttaccaacgccgatcttttaaccgccatcgttaccccgtttaccgacgaggggacgattgactacccggccctggaccaattaactgagcacctgttgcaggccggtaacaacggtttcgtcgtcggggggacgaccggggagacgccaaccctgtcccacgacgaaaagattgaactctacacccacttcggtcggttgattgccggtcgggtaccggtgattgccgggaccgggtctaacaacacggccgaaacgatcgccttcaccaacgaggtggcccaaatcgaggggattgactacgctctagtggtggtgccaccgtacaacaagcccaaccaacggggaatgttagcccacttcacggccgttgccgacgcggtcgaattgccactgatcatttacaacattccggggcggaccggggtcaagatggaaacttcaaccgtcttaaccctggctgaacaccccaacatcgccgggatcaagcagtgtgccagcctggaagaattccagaccctggtggaaaaccggccggccggctttgccgtttacaccggtgaagacgcccaggccctgaccactaaggtactagggggggacggggtcatctccgtggccgcccacaactatgcgccgcagatgcgggccatgtacgacgcccttagtgcgggtaactaccaagtggccgctaagctccaacgctggttgaccccgcggatggcggccttgttcatgttcccgtcgccttccccggtcaaggccgttttggcggcccaggggttggccaccgaccactgccgcctgccgatttgcgacctgaccgcagaagaaaaggagcaattggcaaccgccctggggttacctagcgacgccttggcgggtcaattaccaaccgacttaggggagggactgaccaatgactaaagtattaattgccggttttgctggggcgatgggccaacaggccgtcacattagtaaaatcgctccccggctttgaattgagcgccgtggttgggcaccacttgaccgacctggatccgacaagctacggccttgaaaattcaacgaccgtttacgccgaccgcgagcaggttgaaacgggggcggccgacatctggttggactttacggtgccagcggcggtgtttgaaaacgtctcgtacgccctgcgccacgggatggccccggtggtggggacgaccgggctgagtgacgaacaggtcgaagaactacagcaactggccaagcaaaacgggctggggggcttgattgcacccaacttcgggatgtcggcggtcctcttgatgaagtttgccaaggaagccgccgcctacttcccagaagtcgaaatcatcgaaatgcaccacgaagacaaaaaggatgccccgtccgggacggcgctggcgaccgccaagctgattagcgaaaaccgaccggcccacgaaacggcaccggactcaaccgaaagcctgccgggggcccgtggcggcgattaccaaggaattaagctccacgcggtccgcttgccgggctacgtggcccacgaacaggtcttgtttgggggcagtggcgaagccttaaccattcgccaagactcctttgatcgctcgtcgtttatgagcggggtcaaggtgggtttggaaaaggtcggcaccctgacggaattggtcgtcggtttagaaaacgtcttgtaaacgagtgaaaagagaggaacagagatgccagaagtgattcaagaactaaccgggttgcaaaatcaaaagctcacccaggtgccaccgtcggcaattcgggcctttgacaacgagatttccgccgtcgacgggatcatcaagctaaccctgggggaaccggactttgccacccccgaacacgtcaaggaggctgccatcaagagcatccaagacgacgattctcactacgccccttcagccggcaagccggaattgcgccaggcaattgccaaggtgttaaaaaagacccgtggcgtggactacgactgggcgagtgaggtaacggtcaccgtgggggcaacggaggcgttgacggcgacgacctttggcctcttgaatcccggcgataaggttttggtcccgaccccggtcttttccctttactttccgatcatttccttaacgggggcaatcccggtgatggtgaacacggccgacgatggctttgttttaaccccacagcggctagagacggtcttaaaagaggaagggtcggccgtcaaggcgatcctcttaaactacccgtctaacccaaccggacgctcgtacggggcggaattgattgaccagttggccaaggtcttacaagaacaccacctcttggtgattgccgatgagatatactctgatttggtgtacgaccaggaacacgcctccttggccacccggctgccggaacaaacgattctgatttccggtttatctaagtcccacgccatgaccggctaccggcttggttacctggcgggcccggccagcttaatggccccgatcactaagatgcactcgtttatggtgacctgcgttaacgacgccgcccaggccgccgcggtcgaggccctggaaaacggccaagacgacccgcttgaattccgtaaggcctaccggcgccggcgggacttgatggtgagccggatgcgtaagatgggatttgaaatggccaccccgcagggcgccttttacgtttttgctaagatcccggccgcctttggtagcgatgactttgcctttgctaagcgcctagccaaggaagggcgggtcggcctaatccccggctccgtctttggtgacgggggtgaaggttacgttcgcttatcatacgccgctgctgatgaaaagattgaagaggcgatgaaccgcctcgaagcatttgttcaaacgattaactaagggaggaagctactatgtcaaaggaatacacggtcgcaattttaggagccacgggggcggttgggaaccgcatgatccaacaactagaacaatcatcgatcccggtcaaggagctgcacttactcgcttcggcccggtcggcggggaagaccctgaccttccggggccaggaggtggaggttgaagaaaccaccccggactcctttgaaggggtcgacctggtgctttcttctgccggggggagcacctccaagaagttcttgcccgaagccgtcaagcgcggggcggtctgcgttgataacacctcggcttaccggatggatccggacgtgccgttggtggtaccggaagtcaacccggaggccttagataaccaccacggtatcatcgccaacccgaactgctcaacgattcaaatggtggtggccctggagccgatccgtcaggcctttgggctcaagcaagtgatcgtgtctacctaccaggccgcttccggggccggtcagtcggcactcaatgaattctaccaacaagcgcaagactacctggctggtaagaaaatgacggctgagattttaccgaccaagggcgacaagcgccactacccgttggcctttaacctcctaccgcaaatcgacgtcctggaagactccggctactcccacgaagaatggaagatgatccacgaaaccaagaagatcatggtcggggacatggacgcggctgagccaaaggtgacggccacttgcgtccgggtaccggtggggatttcccacggggaatcggtctactttgaagtcgaagaccaaagcgccacggctgatcaaattaaggaactgctgcaaaacgcgccgggcgttgtgctccaagacgacctcgctaaccaggtttacccacagccactgaccgcagaggggaagcgcgacgtcttcgttggccgggtccgtcccgattacgaaaataagggcgcctttaacatgtggatcgtggccgataacctcttgaagggggcggcgtggaacgcggtccaaaacgccgaatgcttagttgaacggggcttaatctaatagtagcttgacaagtcaaagggggcgggagaagcaattttcccgcccctttttatggttttagatcgcggcggtcaattgacgttggccgggtaaatgagtaataataggggctaaaagaagggcggtccggtcgtggttgaaatcaaaaatcatcagttatccttccccaagctattaacgctgggctttttaattgtaatcttggtggggacggggctattgatgttgcccttggccacccggggagcgcgggccccatttattacggccctgttcacgtcgacgagcgccacttgcgttaccggcctctccttggttgacaccgctagcttttggtcgccctttggtcaagcggtgattgccgtcctaatggaagtcggggggctgggctttatgacctttgccgtcatggcgtcgatgctgattcggcgccggatgaagatgtcaacgcgcctgttggcccaagaagccctcaacttagaccacctttcgcaattgaaggtggtagggttgatcatccgcttgtcggtattgattcaagtggtcggcgccctgctcttgtggtgtgacttagggccccgctacggattattgaaggggctttggtacagcgtttttcacgccatcgccgccttttgtaacgccgggttcgatctctttggtaactcgctagccaacttccgccaggatccctacttgctaacggtggtcgccctgttaattatcgccggctcgtttggcttcttggtctgggatgacctgttgaccttccggcgccaccgccaaatgtctttgcacacccagttggccctgcgcaccggggcggtcatcatggtggggtccgtgattgtctacttaattacggaacgcaacctccaccagttcgccggccaaatggatggctttaaccgctttgtcaacacggtgttcatggcgatcaccccgcggacggccgggttaacgaccttttcgtacacccaactgtcggcagccggcttggccttcaccgttttgctgatgtttatcggggggacgccgggttcgacggccggcgggatcaagaccaccacggtggggctcttggccctccagacactcgcgaccctgcgtgggcgccgcgacaccaccttagcccaccgccgttttgctcaggaaaacgtcttccgggccctgaccctggtctttatctccttagtgatcctatccggggcaattttcctgctggccgaaacccagcccttgccgagccacgatgctctgtctttagtcacctttgaggcggtgtcggcctttgggacgaccgggatctcggtgggaatggcgagccagtttaactttttaggcaaaatgattttgatcgccctgatgttcatcgggcgggtgggaatttacacggtgatgttctcgatctttaacgcccagccccaccgtcaaacgtatcggtacccagaggagcgtgttctaattggataaaacagaaagctttgccgtgatcggcattggccagtttggctcggcgctgtgcgaggccctggtcgaagcggggcaagaagtcctagccattgattctaacgaagaagtaatcaatgacttagccggctcggtaatgcgggcggtgattgccgacgcccaagacgaagaggccttaaaggacctttcaatcggcacctttgaccacgtgtacgtttcgattggcaaggacattgaagcctcgatcatggcgaccctaatcgctaaggacctgggggcaaaagacgttatctgccgggcggagaaccgtaaccacgcccgggttttacagcgggtcggcgccgacctggtcgttcgtcccgagcacgatttggccaagcgcttgatctttgctaagctcaacccgtccctgatcgatgattacgttcacatcagcgacgacacaacgattgccgaggtaaccgttgtcaacccccgcttctttaacaagacactcagcgagctggactttcggaatcgttaccaagtcaacgtgatcgccatcgtcactaaagacgaccaggccaacacactgccggctggtgaagaccgggttgaaaagggcaaccggattaccgtcctgggtaaaacggaaaacatacaacatttaaacgaaattattggtgaagggtaggaaatttaatggatgcacagaacttatcaaagcgcttagccgccgtggcagcacaagttcccaaggggagccgtctggccgacattgggtccgatcacgcgtacttgccagcccatttgttgatggctcagcaaatcgattttgccgtcgccggggaagtagtcgaaggaccctttgaaaacatgctaaaagaagtggagcaccgcggcctagctgaccacttgcttccccgcctcgccaacggcctggacgcaattcgaaaagaagaccggattgacacgattacgattgccgggatgggggggactttgatcactaagatcttggacgccggccaggagaagttggaaggggtcaagcgcttgatcctccagccaaacgttggcgaagaggggttgcgcctttggttggctaagcaccactttgaaattatccacgaagagatcctagaagaagatgaccacgtttacgaaatcatcgtggccaccccgacgcctaacccggtggcctacaaccaacgcgaggccctgtttggtcccctgttaattcaagcgggggggccggtcttcgttaaaaagtggcaaaaggaactagcccgggatcagtacgccatcgagcaaatgcgcagggccaaggaggttccggccgaccgtttggccgcttacgaagcccgggtggcgctaataaagggggttttagaagatgactaagggaaccgaaatcattgcccgctttgagcgctttgccagcccacaactggccgaaagttgggatcacagtggcctgcaaattggtaaccctgatcaaccggtgcacaaagtgatgaccaccctcgacgttcggccggcagtcgtcgacgaagcaattgaccagggggtggacttcatctttgcccaccacccggtcatgtttaagccggccaaggacttagatacccggaacccacaaaacgccatgtacgctaagctcttagcccatcaaattacggtttacgccgcccacaccaacctcgataccgtcaacgggggcatgaatgactggctcgccgatcagttggggttaaataacacgacccccctggtggaggccgacaacgaccctattaccggtcaaccagttgggatgggccggatcggtgaccttaaggagtcgcttagcgtcagtgactttgctaagcactgcctaaccagttttggggtgaccggcttacgggtggttacgccgacaccggcccccgcgtcgatcaaacgggtggcaattttggggggctcggggagtgagttttacttaaacgcccagcaaaagggcgcccaagcttacgtgaccggggacgtttcctaccacaccgcccacgacgcccaggcaagcggggtggtgttagttgaccccggccaccacattgaagcggtcgccattgaccaattggctaacttgttgcaaaattggcaacaagagcaccagtggtcaatcacgctttaccgctcccaagtcaacaccgagccgtttcagtttgtcacaaagtagttagaagggaagcatcaagatgacagattcaaagtacccaggattattggaacgtttcattaagtacgccaaggtggaaacccgctcagacgaccaatcgaaaacggtaccgtctagccctaaggaaacggcctttttaaagcagctagcagccgagctgacggaattggggcttgaaaacgtgcggattcacccccaaaactcctacctgttagccaccatccccgccaacatcgaccgaccggtgccggtgatggggctcctcgcccacgttgatacggcggactttaacgccgaaaacgttaacccccaggtggtggaagactacgacggccagagtgacattcccctgggtgattcgggttacaagttgacgattgacgaatttccctccctcaagaagtacgccggtcaaaccctggtgaccaccgacgggacgaccctgctcggggccgacgacaaggccggggtggccgaaatcattaccctggcggcctacctaaaggaacacccggaaattaagcacggtcagatccaaatcggcttgggcccggacgaagaaatcgggaccggggccgatcacttcgacgttaaagactttggtgccgactttgcctacacgattgacggcggcccgctgggggaactagaggacgaaaccttcaacgccgctcaagccgagatcgacatccagggtaaggacgttcacaccggcacggccaaggacacgatggtcaacgccattcaggtggggatcgacttacaaaaccaactgccggtgcacgaccggccggaaaagacggccgaccgggagggcttttaccacctttacaagttcgatggcacggttgaccacgcccgcttagtctatctgattcgtgaccacgacaagaagctctttgaggcgcgcaaggaggccttacgggcgatcgtgcgcgacctaaacgctaacctgggtgaggaccggatcagccttaacttgtacgatcagtactataacttaaaggacgccttgaagggtcacgaagacgtggttgaactggccaaaaaggcgatggaagacctgggcatcaagcccgacatttacccggtgcggggcgggacggacggctccacgatttcttacctgggcctaccaacgccaaacctctttgccgggggtgaaaacatgcacagccgcttcgaatacgtttccgtccaaacgatggaaaaagcggtggacgtcttgttgaaaatgatcgccttaaacgccgaagaataaggccaacaaaaaaagggaacgaactgtgcagcacccaagttcgttccctttttgagttgattgttgaccggctagttagtgtggcgtgacgggtcagcgtgactagtcatccaagacatcacgttaacgaagatcaaggctaccaccccaccaaggatcgctgcggtggtgaagttagtggtcgccgattcaagttgaccagcgatgtaaccaatcaccagcccgaagatgacgccccaaaagacggccattacattttgcattactaatttcatgaagttcacccctttaaagtacactggtattttagcacaaaatgaagggggagaacagtgaagttattaacttgccctgtggtaagataagtaagaagaaaaggaggggttgaaatgggctttgtacccttagccgttaagagtatgtactccctactagaggcgccggttcgccccgcggagctggtggcggtagctaaagagcggggctaccaggcggtcggccttgttgatgcgcgggtcttgtacggggcggtcaacttcgttcgccgggccaaccaagccgggctacacccggtgatcggcgtcagcctaccgctcacctttgcggagggaaccttagacgtcaccctgctggccaagggggcggtgggctaccaaaacctaacccgcctctcgaccagggcgatgaccgaccgggccaaccaaccactaaccatcgaagatttgcgggaggtttcagacgacctggtcgtgatcgtggccccgcagttgatgttattgggcgttagtgagcaaacgtacgcccagctcggagaagtggccgactacctggggattaacctcgatttcacggcggccgagcgccaggacttacaagccgtcgccgagcgctgtgggctgcccctaattgccttcgagccggtcgagtacctcaacgaggatgattactttgccacccaggtcttacgggcaatcaaggccggccacacgattgaagaccccctcaaggccagtcagcgaacgggtcggcactggttgcggccggctgaagaggtggcggcggcctaccgggcggcggggcttgcggaagcggcggcccaaacggtggtggtggccgaacggtgccaggtccactttgccgatcaaacgccggtcctacccgcttttccgactccggccggccagggcgtggctgactacctacgcgaactgtgtcaacgggggttggctaagcgaaagttggccggtgatcccgccgagtaccaggcccgcttggagcatgaattaaccgtcattcaccagatgggctttgacaactactttttgattgtctgggacttgatgaactttgcgcaccaacaccagatcctgaccggacccggccgggggtcggcggccgggtccttggtggcttacgccctggcaattaccgacgtcgacccactccaatacgggctgttgtttgaacggttcttgaacccggagcgcgcccagatgccagatatcgatttggacctgccggataaccggcgcgaggaggtcttaaactacctccaccaccactacggtcacgaacgagttgcccaaatcattaccttcggcagcttggggaccaagcaagtcctgcgcgacgtcagccgggtctttaacttacccaagtatcaggtcgactcgctcagccaggtgatcgaccgggttaaggggccccaccagaccctcgccgacctgttggaaagcgcccagccggtccaaaacctggcccgcgattccaagctcgtggcctgcctgctggaagtggcggccaagctagagggcttaccccgccacgattcgattcacgccgccggagttgtcttggccgccgaacctttgatcaagacggtgcccctgcaggccggtaacgagccgggggcgatgctcgtgacccagtttgaaaaagacaccgtcgaatcactggggctactcaaaattgacctgctgggtttgcggaacttaacgacggtggaaacggcgcttaacttgatccaccagcaccagccggactttgacctcacccacattgctttaaatgaccgaccgacgctggccctttttgaccgcggccagaccagtgggatctttcagtttgaatcaagtgggatccgccaaaccttggtcaacttgcacccggataactttgaagagattgtcgccgttaacgccctttaccggccgggcccaatggacaacattaaccacttcatcgccagaaagaagggccaagaggcggttaacttgccggctaaggaactagccccgattcttgcaccgacctacggaatcttggtttaccaagaacaggtcatgcaggtggcggcggtgatggggggctttagcctgggcgaggccgacttgttacgccgggcgatgagcaaaaagaaactagcgaccatggcgagcatgaaggaggccttcttagccggggccaacaagcggggctacccgaacgccgttgccgaacaggtctttgcctacatcgaccagtttgccaactacggttttaaccgctcccacgcggttgcctattcgaagatggcctttgaaatggcctacttaaaggtccacttcccggccgaattcctagcagccctgatggaaaccgacccggataccagtaaggtctgggcctactttagcgaggctaaggaactagggattaccacccacggaccggcgatcaaccagagccaagaacgggtgagcctagtcgaccaggagttgtggctggggttagacatgattaaaggcctgcgccgtgactttattcgggcaatcattgaagaacgcaaccaacacggcccctaccaggacttgcccgacctggtcaaccgcctcgacgccaagtggcacaaggaagccctctttgtacccctgattgacgcgggggccttggatcaccttggttacaaccgagctgagatggccgagggtttaaaggcgattttggagggcgccgagtacgccggtttgggcttggggatggcacccgtggttgcccaacgcaatgagtacccgctcgccgttcgcctggcccgcgaacacgcggtcctcggaacttacctttcggggcacccggttagtcagtaccaagacctccgaaccaagttaaagttaccaaccgtggcccagctacggcctaaccagcgggtacggttggttttaatggtgacccgaatgcgaaaggtaacgaccaagcgcgagcacaaaccaatggcctttttaaccgctagtgacgaaaccggggcagttgaagtgacgatctttaaccgcctcttcacccagctcgaaggtgagttaagggtcaacgggatttacttgattacggccaagactgagcaacgagagggccaggtccaactcttagccgatcaagtgaccgacgcccaggtggtcaaccgggaattacacccggccgaccaccgttgggtactccgcttacctagtggggttgcgcagaccacggtgaccgacgggatcaaggccttggctaaggaacacgccggcaacgtcccagtggtgatttacgacccggtcactcaaaaagccactcaactgcccgggcaactgtggttagctaagcaacgggtggtccaagagggtttgattaacctggtggggaggagcaatttggccttccaagcgttaagttaggtaaaccaaatcaagaaaccgtttacagcgaaaaatgccggaaatatacaagacacccaccccaaaaggtgctatgataggcaatgtgaaaaaagggactaactagtccggaaaacgcaaaaggagagatgtcacttatgaagaagaccaagattgtcagcactttggggccggcaagtacggatgttgacacgattgtaaagttaattaacgccggggcgaacattttccggtttaacttctcccacggtgatcacccagaacacctcgggcggattgaaaacgtccacaaggccgaagaaattactggcaagcacgttggaatcatgcttgataccaagggggctgaaattcggacgaccgttcaaaaggaagggaagatcgaattcaacatcggcgacaaggttcggatctccatggacgacagcctggaagggacgaaggaaaagatcgccgttacctacgccggtttatttgacgacgttcacgaaggcggccacgttctctttgatgatggcctgctcgacatgttggtggacgaaaaggatgaagcaaacaaggaacttgtctgccacgtcttgaaccacggaatcctcggttcccgcaagggggttaacgcaccgggcgtttccatcaacttgccagggattaccgaaaaggatactagtgacatcaactttggtctggacaacgggatcaacttcatcgccgcttccttcgttcggaagccacaagacatcgaagacattcgggtcttgctgcgcgaaaagaacatggaagacgttcaaatcttcccgaagatcgaatcccaagaagggattgacaacttcgaagcgattatcgaagtcgctgatggtctgatggttccgcgtggggacatgggggtcgaaattccggccgaaaacgttccgctggttcaaaagaacatgattcgtcgttgtaacgaactgggcaagccggtcatcaccgccacccaaatgttagactcgatgcaagaaaacccacggccaacccgggcggaagtttccgacgttgccaacgcggtctttgacggcaccgacgcaacgatgctgtctggtgaatccgctaacggggactacccagttgaatcagttgccactatgaaccggatcgacatcaaggccgaaaacaacctggacaagtttggccgggaagtctttgactttgacaagtctgacgtaactgaaacgatcggttccgccgttgccacggctgcccgtgacttaggggtaaaggcaatcgttgccgctaccgcttctggttacacggcccggatgatctctaagtaccgtccttccgctgacatcttggcgctcacctttgatgaacgcacggaacgcggcctgatgatcaactggggggttcaaccgtacgtggttgaaaagccaaccagcaccgatgaaatgtttgaattagcatccaagaaagccaaggacttaggcttcgccaacgttggtgacaagatcatcgttgtggccggtttgcaaatcggtcaacacgggacgaccaacatgatgcgggtgcaagaagttaagtaagcaattcaactggggaacgtaagcgagcacgggtcccggttaagtgcttggagcgtgatgcggagtcaaccggcttcgccacgctccttttcttttggcgtaaatttttgtatcataggttgttagttaagcactaggtaagcggaggaaatgaaatgaaccaagcactcggtaaagtcgtgacggcagtcatgattgatgaaaacgaccaggactactttgtccaaccggatcgcaacgggcagacctaccgtctccccaaggatgaagccccccaggtcctccacattggcggatcggtctccggcttcgtttatgaaaacgaccagcaccagctccagatgacgtgtcaacacatcccaaccgttgccgtcgatcactatgacttcggaacggtggtggcggtgcgccgcgacctgggggtctttgttgacattggcttgcccaacaaggacgtggtggtttccttggacgaactgccgactttaaagcacctctggccccaaccgggcgaccgcctcttgatcgccttgcgcgtcgatgaccacgaccgcctgtgggggaccctcgcggacgaagcgatttttgcaacgatcgccaaccgccccgaaaagaagatggtcaattggaacgttaaggcgaccgtctaccggttgaagatggccggtaccctcgttttgaccgataattactgcctgggctttattcaccccagcgagcgggaccaggaaccgcgcttgggtcaagtggttaacgcacgggtgattggtttgtccggccacggtagcctgaacctgtccttaaagccccgggcctaccaggcaatcgatgatgacgccaagcagatcctggagctgttgaaacgtgcaccgcaaaagcagctccccctgaccgataagagttcaccagaagaaatcaaggagctgttagggatttccaaggggcagtttaagcgggcggttggccaccttttaaaggcccgcttggtcagccaggtcaacggccggctaattttaatcaaagaggcgccagtaaatgaataaggggtcagacgccctgcaagcttcactagtcagctaccaggagtggttgactaaaaaggggggcgccaagttgaccatcgccagttacttgacggatctgcgggatacggctgcctatttaaccagtcggggggtcactaattggcagcaagtggaccgggctactttaacggcgtacttacaatcgttaaacgataagggccggcgaacaacgacgattcagcgccggattagcagcctacgtcgcttttatgcgtacttacaggtgacggggcaggtcaaccacgatccggtcgccttgctgaaggctaagcaaacgccccggttggccccggtcgggttaacgccgcaagaggcggatttgctacctgatcacgtcccgggcaagggggtggctagggaacgcaaccgcgccttagttgcactcttggtggcgaccggggcgcgggctaacgaactttgggacctgcaaacgggtgacctcgacctggaactgggggtcgtctacctggggcagtcctcccggcgcttggtcccgctcaacgaacaggcccaaacgtacttgacgacctacttaaccgccagggccgaccagtcggcgaccgatgagggatacgtctttttaaataactggggccagcccctatcgcgccagtcaatctgggagattgtgaacgcaactgggcagcgggccaacattgagggggccgtaaccccccagcgggtccgggatggctttgcctaccgcctgctagcccacggtgctgatttaagccttgttcagcaactgatggggcaccaaagcatcctgacgacccaagtgtacttagagcaagcaaaggaggggcaccatgctgatcgcttaccgtaaggactaccaaaagattgcgatggggttactgtcactcttgcccccctttaaggattaccaccggctaaaagcggcgattgactggtcgggggagtccgatcagctgatttacctgtggcaaaacgaaacgattggccaattcaccgggatcgtcgtggtttccgttggccaagactacgtgttagtccggcacctttcctttacgcccagtgaccgggcgggcaaaaacgtgtttgccttgctagcggccctgcaggagaggtacccccaaaaacggattatgggaaccttgaccacccagggggtagtgaccaactgggcccgtgatcgctactaccgccagggaggggatttaaatggctgaacaagaactggcccgcttggtggggcaaccgacgctggttttaggtgactttgaggggccgctagacctcttgttacacctgatcaaaaaggccgaagtcgacatctacgacattccaatcgccaagattaccaaccagtacgttgaatttttgcaccaacaggagcaaaaccagctcaacatcgccggggagtactttgtgatggcggcgaccttaatgtcaatcaagagtgcgatgctattaccgagccccccggtggttgaagatgagctaccacctgaagaagaggatccccgggcggaattggtggcgcaacttttagagtaccaacgctacaaaaaggcagcggcggccctaaaggataaagaagaataccggcagcgggagtacaccagagaagcaatggcggtgccaaagaacctggtagagacccgctttgccccgggggttggcattgaagagttacaacgggcctttgaagacgtggtcaagcgccaccactttcacgaaccgattacccaaaccgtcgatcccgacccggtgacggttgccgagcggattgaacacgtgattaccgtggtgaccaagccaacccgctttgaggacctgtttgaaaatgattggaccaaagacagtctggtaacgaccttcttggcggtcttggacctgactaaacaccaggtgattgccttggcccaatctgaacgcttcggcccgctgattgtaatgccgggcccacgaaacgaggaataccgaaatggagaatatcgcacaaattgagggcttgctcttcatcgctggtgacgaggggatcagtgttgctgacctggcccggatcaccgggtttatgaaaccagccgtcaacgaactattaacgcgcctacaagaaaagtaccaggccgacccccagaccgctttaaccctgcttaatagcggggaggtctttcgtttggccaccaaagcggaactggcgccggttatgaaaacttactttgaggttccactaaccaccccactgtcgcaagccgtcttggaggtcttggccattgtcgcctacaagcagccactgacccgcttggaaatcgacgacatccgtggcgtgcaaagctcggggtcgctgcaaaaactcgtggtgcggggactggtccagacccacggccggctcgaagtacccggccgccccttcaggtacgtcacgaccccggcctttttggactactttggcctgcagtcgttagcggacctaccaccgttgcaaaccgacttgaccgaagacgacctggacggggacgtcttcttacgggcgctacaatcacgaactgaagaaggaaaggaaaacgaatagatggtaaaagaacgtctgcaaaaggtgatcgcccacgccggggttgcctccagaagggctgcggagggcctaattctcgccggcaaggtgaaggtcaatggccaggtagtaaccgagctggggaccaaagttgatggcaacgatgaggtgatggtcaacggcgaaccggtcgaacaagagcaacacgagtactatttgctcgataagccacgcggggtcatttcttcggcccacgatgataaggggcgcaagacggtggtcgatatcttaaaaaacgaaggggtgcaaacgcgggtctacccggtggggcgcctcgattacgacaccaccggcctcttggtgatgactaacgacggggaattagccaaccggttaatgcacccccgctttgaagtcgataaggtctacatcgccaaggtcaaaggcctcgtttcaaacgatgagatgcggctgctccgcgaaggggttaaaattgatggcaaaaagagccaaccggcccggaccaaactactcgaagcaaaccaacgccaaaagacctcggtggttaagttaaccattcacgagggtcactaccatcaggttaaaaagatgatggaagcggtcggccaccccgtgcttaagttgcaccgggaaagttatggaccgctgactctagctgggctcaatccaggccagttccgcaagctcaaggtcgatgaggtgcgggccctacgcaagttgtattaatttgaaatacagagccgggtgggttataatggttaagaattaaataaattaataggtttgtcttcaaggcagggtgtaattcccgaccggcggtatagcccgcaacccgcacacgcggtggaacccggtgaaattccgggtgccgacagtaaagtctggtatgtagaagatcatcacaacgatgtttcaaccgggagacgccctgatggtgtccccggttttttcgtggtagtggttgaaaccaagaagatgacctcttggaggttatactatgtctcttacccatacccgcgttcagcgcctagccgtcttggcatgcatgagtgccttggcctttgtcttaatgctgtttgagttcccggtcattccggttgtgtcgtatttgaaaatggacttttccgacctgccggttttgatcgccacttggctctacggtccggtggccgggatcatcgtggcggccatcaagtgcctcttgcacggcttgatgtacgggatgtcggttggcgagctactgggtgttttgtccaacctgctgtcgtcaatgtcgctcttgttgccgtttgcttggttccttcgccggggcaagggaagtttgaagcggcgcctcttctttggtggcctatgggcaacggtagccctaacggtggtaatgtctttattaaactactttgttttaacgccggcctacatggccctgtgggggtggaaaccaagcttaccactgccagagctagtagcaatcggggtggtgcccttcaacctgattaagggaatcttgttgagtttgatctttggtttcttggcttggagcctacgggattgggtggccgcccggttagaccgttaattggagcacatttgaaaatcactagggagtgggaaatgaccctcgaaaaagaccgtacctagacttaggtctgaggtcactttccgtccaatatttatgaatccagtcaggggctgggagaaaaacgtcttttctcttggtcctttttcttatggtaagggctgtttataggtgcttgtcaggcttggcaaaacaccgtatgctaagtgtaaaaggggggctagcagtgaacgattactggttggttttatttgatcaggaaccgcggcggtttcgagtaattgaaaacctgttaaaaaaccgtttgtcagaggcgacgatgttctgggcgatggtctacggaattcaggaggccgtcgccggtcaacgtcagttaaagcgggcggagtttgacaaatggatgaaccagcaggtcacggcggggctaatggtgcaagaagaaggccaggcctggttgaccaccgcggggttagtcgaaaagcaacgcttattgactgaacactaccaaccccgtttcggtaactgggggtggcgaattaacccggaacgcttggccaaccggctcctattggggattcaagtggtttccgagtttgcccaccataatcgtcgctaccgtcccttaaaccttggtaactacgagctgggaaccgttaagcagtggctcctcaagagtgggcgggggatccaaggggccgttgaacagcaggttaccgccgcctttgctgccctagaaaaagtggatccccgcttgccccaggtgctagcggccctgttaatcggtcaccagaccagcggggcaacgcttggtcagttagcgcgtgagctccgggtgagtgagggcgaaacggcgatcattatccatgacgcctggctagggttaggagcctacttagccaccacccccgggccgctcagtcagttggtgggtcccctaatttctaacagcccgttgacgaccagcgcccagcagacggtcgccgattttttgaccggtcaaagccccgtggcaattagtcgtcgtcgccaccgtaaattgtcgacgatccgtgatcacctgttaaccgccgccattttgacccccgggatggcggactggcgcaccctctttccggccgggatgctagaagagttggcaaatcgctatcaaggaccggtggcgagttggcagttcgtggcgacccacccggacctggacttaaaccaggagtttttcttgtttcgcttgtaccaaatcatgaggtgtcaaaacagtgaccattgatgaacaacaagtccgcaccgcactgaaacggtttttcggtttcgctgactttcgtcccggacaaagggagacgattgaagcgacgttggcggggaagccaaccctggccgtcttgccaaccggggccggcaaaaccctcctttaccaactcccgggggtaatgttagacggcttggtggtggtcatcgcccccctgatttccttgatgcaagatcaagttgatcgcctgcgtagcgatggcttagggccggtggcgagcctcaattctagcctcgattaccaagagcaacagtgggtgctgagccacctaggggagcttaagtttttgtttacttccccggagaccttgctcaagcccgccgtattaagggcgttgcaccgtcaaccgattagcctgtttgtcgtcgatgaggcccactgcgtttcccagtggggccctgattttcgtccggaatacctccgggttgcccaggccattcaagcggtcaaccccgcgcggctattgatgctgacggctacggccacccccgtaatccaagatgatatcattcagcgtctaggcctcaatccggccgcggtggtgcgggtcgttaaatcggttaatcgccccaatattttcctggccgtccaaaaactagctgaccaagacgaaaagcggcgccgccttctcgaactggtcaaccaattagggcccagtggggtggtctacctctccagccgtgagggggccaaccaattggcggactggttaaatcaacaagccaacttacgggtggcggcttaccacgccggggttgaccccgttgaccgctaccgaattcagcagcagttcttaggtggagaattggacctagtggtggccacgtcggcctttgggatggggattgataaacaagacatccgttacgtgatccactttcagatgccggggagtttagaagcgtacgtccaagagattggtcgggctggtagagatggccgccagtccttagccgtgctcttatattgtcacggtgatgagcagttgccactcttgttaaaccacgtcgatttaccaagccccgccgtcttagatcaaatcaaggcgggcaaggtgaaggccgatcttttaggggaggctaagcgcgtggtcacctactacctggaccagggaatggacgggcaggcggtgtggcgcttttttgcggacctagaacaaaagcggggccgccaggtgcaacggatgttaagttacgtcgaggaagacaagtgtcggcgaactaatttactagcctactttggccaagtaagtctggaggcggaggtcgagtggtgttgtgacctgaccaaccgggactggacggtgaccgctttgcaactgcccgcggtcaaacggcgagtggcttcgtccgtcctcgattggcgaaaccgggtcgcaactttgttcaaccgacaggggttgggctagacacacggcgctttgatgcgctacaatcgttgatgaaatctacttaagggggtgtggcacatggctcaacgccgggaagatcaacggaacgaaaagctctgggataagacctttaccgataaccaagacatcgataaagaagggcacctatcgcggatggcacaccgcaagcaaagtacgcacaacgcccaaatcaccacgattttaatcgtcttgatcattattttggcggcgaccccggttttatactgggttaaccaccagcagtcatttaatcacccgcaacgaacggtgaaggtggcgtcatcttcgacagcaacgtctaaaaaaaaagccagctcaaccagttcatcagctagcgtgagtaaggggaaacaggccagtagcagttcttctgtaagtaaggcggccagcacctctagttcatccgcgttggcaagttcttcgagtgctagcagttcgtcaacgacggctgtttacacaactgttgagtccggacaagggatttaccgggtggccaaggataatggcttaacggtggctgagttagcctctttaaacggcatcaccactaccacggcaattcatcccggtgaacggttgcgggttaagtaatatttaggagtgaacatttttatatggtaaagggaattcaagttgcaattgacgggccggcttcggcgggaaagagtacggtcgccaagctcgtggccaagcgcttcgggtacatttactgtgacaccggggcgatgtaccggtcggtaaccctggccgctttagagcggggaattgatttaagccaagatgacttggtgagtgaactggctaaccaaatcacgatcaccttcgcccccggcgacccacaaaaggtcttcatcgacgggcatgaggttacccaggcgattcggtcgacggaagtggctcagcacgtttcgacggtggccgccattccagccgtacggagccggatggtggaattgcaacgtcaaattgcccaagagggcgggatcgtgatggacggccgtgacattgggacgaccgtcctcccggatgccccggtcaaaatctttatggtggcctcggcacacgaacgggcccggcgccgcttcttggataaccaagagcgggggatcgacggtggttcaattgaagaactccaacgggcgatcgaactacgggatcaaaaggattccacccgggcggtttctccgctcgttaaagccgcggacgcctatcaactcgacaccactcacctgaccattgagcaagtggtcgatcagattgccggtcgaattgaaaaaacactgaaacaaaaatagtaaaagactagcaatgtcagttcggatcctgtaaaatggtgtttagagttgattgttgcaaggaggatatttttagatggctgaaaacgaaaacaataacgctatgttagaagcacttgactccatcaagacggtaaacgtcggtgatgttgttaaggggagggtattacaaatcgacgacgaccgccaagcgatcgttgggatcgaagactctggtgtggaaggggttgtcccagccaaccaactgtctaccaagcccgttgacaacatcaatgatgttgtcaaggttggtgacgaacttgacttggttgttatctccaagatcgggagcgacaaggaaaatggttcttacctgctttctcatcggcgcttagaagccatgaaggtttggaacgaaatccaaaagaagtttgacgatggcgaaaccatcaccgctacggttacgcaagccgttaagggtgggttggttgttgacgccggcgtccgtgggttcgttccggcctcaatgattactgaccactacgttgaagatctgaaccaattcaagggcgaagaacttgaattcaagatcattgaaatcgaaccaagtgaaaaccgcctgatcttttcccacaaggaaatcgttcaagcacaacacgaagaagctgccaagaagatcttctctgaattggctgctggtgacgtggttgaaggtaaggttgcccggatgactaacttcggggccttcatcgaccttggcggtgttgacgggttagttcacgtttccgaaatttcttacgaccacgttgacaagccagccgacgttctggaagttggtcaagaagttaaggtgaaggtcttaaacgttgacccagaacgcgaacggatttccctttcgatcaagcaaaccttgcctggcccatgggatgacatcgaagaaaaggctgccgttggtactgtcctgactgggacggttaagcgtctgactagctttggtgcctttgtggaagtcttccctggcgttgaaggtttggtacacatttcccaaatctcccacaagcacattgctacgccagctgacgtgcttgaagcagggcaagaagttaaggtgaaggtcttaaacgttgaccctgaacgtcaacgtttgggtctgtccatcaaggcgcttgaagaagctccggcgggcagtgacaacaataacaacaacggtggttcccgtcgtccgcgtcgtcgtaacaacaactacatcgcagacgcaccggaagaagaaagtggtttcaacttgggtgacctgcttggtgaccaattgaagaacttcgacaagtaatcataaccatcaataagcagggccgggagtaatcccggctttgtttttgccaaaatttattgaagggaggaaacttcatggcaaatccagtagtagcgattgtcggacgcccgaacgtggggaagtcgaccctctttaaccggatcgccggggagcggatcgcaatcgttgaagacacccccggagtaacccgggatcgcctctacgcccacggggaatggctgggcaaaaacttttcgatgattgacaccggggggattgaaatgtccgatcaacccctcttaacgcagatccggcaacaggctgaaatcgcgattgaagaagccgatgtgatcatcatggtcgttaacgttgaaaacggggtgaccgatgccgacgagcaggtggcccaaattctctaccggtccaacaagccggtcgtcttggccgtcaataaggttgataaccctgagcggcggctcgacgtttatgacttttaccaacttggtttgggtgaaccgtacccggtttcgtccgttcacggggttggccttggtgatatgctcgacgccgtgattgaaaactttgccgaaaaggacgccgaagaagaggacgaccggattcgcttttcctttatcgggcggcccaacgtcggtaagtcctcgctcgttaacgccatcctaggcgaaaaccgggtgattgtttcggacatggccgggacgacccgtgatgcgattaacacccagtttacggcgaaggacggtcgcgaattcacgatggtcgacacggcggggatcaaaaagaagggcaaactctacgaaaataccgagcgttacgccctaatgcgctcaatgcgggcgatcgatgactccgacgtcgtcttagtcgtgttaaacgccgaagaggggatccgggaactcgataagcacattgccggctacgctcacgaggcgggacgggcggtgatcatcgtcgtcaacaagtgggacacgatcccggaccgggaccaacggacgatgaccgactttaccaacctgatccgtcacgaattccagtaccttagttacgccccgatcgtgtttgtgtcagccaagaccaagcaacggctgtcccgtttaccggagatgattgaagaggcctacgatcaccaacaacggcggattcaatcggcggtcttaaacgacgtcttgatggatgccctggccgctaacccaaccccatcgtccaacggccggcgcctgcgggtttactacgcaactcaggttgccgtggcgccgccgaccttcgtgatcttcgttaacgatccggacctgatgcacttttcatatgcccgctacttagagaaccggatccgggcggcctttgactttaccgggaccccaattcgcttaatcaaacgccggcgcaagtaggaagaaaccgcttgcgcaaggattgagggcggaaatttcccggaaaatggcaaaaatggtaaaaaccccgggaaatgccttgctaacggggttttactatgctaatctagtttttgaaataatgcgaaggttcgtcattgtttcgttaattttggaccactcaaaattaacaatcactggatcaccccccgtggagtgatcgttagtgggaggtgaaagtgacatggcaaacaaggcagaattagttaccaacgttgcaactgcaaccggtctgactaagaaggatgcaaccgcagctgttgacgcagttttcagctccatccaagcttccttggctaagggtgaaaaggttcaactgatcggctttggtaacttcgaagttcgtgaacgtgctgcccacaagggtcgtaacccacaaactggtcaagaaatccaaattcctgcaagcaaggttccggcattcaagccaggaaaggcgcttaaggacgccgttaagtaagctttacttagcgtaaacgaggggctgtgacaagtacgtcacagccccttttaaggtcaattagaaaggggtaacactgtgacctattcagaacaaatgttagaccacattgaagaaggtaccatggaccaggcccaaaaagacttcgcctgggccctgcggaaggatgacgatgacaccctctacagcttggcggaagagctttacgcactcgggttgaccaaccaggcccagcgaacctatttaaagcttttggaccgctacccacaagaggatgagttacgaaccgccttagccgaaattgccatcgacaatggcgacaatgacgaggccctttcctacctatcccaaattcaacccagctcgccggcttacctgcagtcgctgctggtgcaagccgacctctaccaaaccgaggagcaatttgaaattacggaggccaagttaaacgaggcctaccggatggcgcccgacgaacccgccgtcttgtttgccctggccgagtactactacctaatcggtaagttccaagaggccattcccttttacttcgccctgattaaggcgggccacctcgaattcgcgaaggttgacattgccggacggttggggaccgcttacgcccagctcggtaagtttgatcaggcactgggttacttaaatcaggtagcgcctggttatcaaaccagtgacatccggtttcagaccgggttgacccagttagccctccaccagctcaaggaggccatcattaccttcaaggagctagcagaagacgatggccaatacgcctcggtctacccggccctggcccaagcgtacgccgaagagcaccactacgcccaggccctgaccaccctgcaagaaggattggcggttgaccagtacaatgagcacctgtacgcccaagcagccgagatggctagccacgttggcgatacggaattaatggcgacctacttgaagcgggcccacgaactggatccggataaccaaaccattaccctccagtattccaacttcttgcttcaccaaggtcaagacgacgagaacctcgccctcttggcaccgctggtggacgaaaacgatgatccccaagttgagtggaatctggcccagtcgtacttgcacaaagaggactttgacggggccaagcaagcttttgaagcggccgccccggccctgagtgataacccaaccttcttgcgtcagttgattgagttttaccaggaaatggggatgcgcccgcagttgcgggaggccgttgagcactacctggcgattgatccggccgatagcgaactacaagaactcctagaacaactggacgaagactactaaccagataacggaaacccgtgagaaacggggcataaagcagagcagagcccaagagaaagcgccgcttcctcttgggctctgcttgtatttccaaacgttagtggccaatcaccctagtctttttccgccgattgttccgccctgtcttgattaaacaagagccggcggtagtagagcaaggaggccgggtcaatgcgcaggacctccattaattgctggtccgaccagtcccggtggaggcggagttggtttaagacgtaaccctggtggaggttacggggggccagcgagaagttggttaacgactcgtcggccttgaggtacttgtgcaaaccggcgttggtaaggcgtggctgattgtggttaagccgggtttttaaaaagggatccgtgcacccctgcaggtccgcgaggggttggtggaaaacgttaaaggcgactaaaaagttcttctcggccttagtagtggggctcagtcgccgcagttgttggccaaagtcgggggccaagaattcgccaaccgtgtagcccttagccgagaggaatagggttaaacgggtgtagaagtggagttggtcactttccaataattggtcgagttggttaacccacttggggctgaccttcaccgccgggcgggggagggccccgtgcagggtcagggtcgggtaaccatggatcagttggtgagtgaagaggtagcgaaagtaacggttgaggtgggataaaatcttattggtggtcgccagcgtcgccgtccggtcgtctttgaggtagttaaaaaaggcccggacgtcggtttcggtgaccgcgtccacctgggggtcgtgggcaaaggcggggcggttagcacgcaagaagtcaaagaagctggtgaggctggtggcataagttgccaccgtcagcggcgccagtccctgttggattaaaaaattttcaaacggttgttggtaggggtaatggtctgccataagaacacctccaagtaagcagatatttactataactatacacccactcaaacaaatcgccaacaccctaacacgaccagccaaaatttgctagaatagattaattgggtgccgagcaagtagtaattgtccgcaccttaaatttggacgaaacggggcttcaccatgaaaattgagacgctgccggcggaatttgaaccggcccgcccaatcctttcgcgcattgaagaagctggctttgaggcatactttgtcggcggctgtgttcgcgatacgattttaaacttacccattcatgacattgacatcgccacctcggcctacccggcggagatcaaacagatcttttcgcggacggtagacaccgggattgaacacgggacggtgatgattttagatcacgggactggttatgagacgaccaccttccggaccgagtcgggttaccaagatttccggcgtccggattccgttaccttcgtgcggtctttaaaagaagacttacagcgccgggattttacgattaacgccttggctttaaaagaggacgggacggtggtggacctttttgacgggttaggggatttaaagcgccacttgatcaaggcggttggtgatccggccgagcggtttcacgaggatgccttgcgaatgatgcgggcagcccggtttgccgccaagcttggttttcaaatcgagccgggcacgctggccgggatgtcacaaaacgcggccctgttggaaaagatcgccgttgaacggatccaggtcgaattcgaaaagttactccttggtaaggcggtccaaaacggtttggctaccatgttagacaccaagctgtacctgcattgtccaggactgaaggagggtggccaagggctccaatatttggctcagcaaccactgacgttaaacaacgccacgcaggcttggggagcacttgcaatctgcttgggccttgataaaaaccagctgcgccccttcttaaaggggtggaagctatcgaatggtttgattaccgccgtttctcgggccgttccactggtggaaaaactgacgactaaggcggctggggcaagtgatctttaccaggcgggtcagcaagcggtggcagacgccgtcgtgatcgccaactccctgggtggtcaggtcgatccacaggcggttcaagcagcgtaccaggctctaccaattaaggagagcggcgaattggccttaaacgggggcgacctaattaaagcggggtttaagccggggccagcaatgggcaaggccctcaccaccctgactaaacaagtggttgaaggtcagctggccaatgattaccagaccctattaaaggcggcgggcgagctgttaaaggcgtagtaaggaggaaacatgcagacattacgtgcggataatttaacgagtcgttacggcgaaaaggtgctctttgaagacgtgtcctttttgattaacgagggcgatcggatcggcctgatcggtactaacggtagtgggaagaccagcctcttgaacgtgattgccggtcaaaccggtgccgatgccggccagatcactaagccgggggactacacgattggctacctgatgcagcagccgagttttgacccggatttatcgattaccgatgcggtttttgcgggcagccagcgggtctttcaaacaattcgcagctatgaagcggccctcacggagtacactaaccaccccgaagatgcggcggcggccgatcgctttgccaagctgcaagcgtccatggaccaagaggacgcgtgggacgcggattcccggattaagacgatcctgacccaacttaaaatcaccgacatggaccagaagatgggggaactgtcggggggacaagtgaaacgggttggcctagcgcaggtcctgattcaagaaccggacctcctgatgcttgatgaaccgaccaaccacctggacctggcctcaatcgtgtggcttcaagaatacctagcctcgtacaagggggctgttttggtggtcacccacgaccgttacttcttggatcaagttactaaccacatttgggaattggcctacggggtcatgcaccactacgacggtaactaccaagccttcgtcgaaaagaaggccgaacgcctcgaactctcccaggctagtgaacgcaagaagcaaaacctgtacagaaaggaactggcttggatgcgccacggcgccaaggctcgttccaccaagcaaaaggggcggatcaaccgctttaacgagctcaaggactccctgggccaggtggaaacggacgaggacatcgccattgacctgggttcacaacggctcgggaaggacgtcatcgaactaaagggcgccaacctgtcccttggcgaacaccacatcttacaggacttcaacctgctggttcagggtggcgatcggattgggatcaccggtgaaaacggggccgggaaaaccagcctcctcaatgtcatcgcggggcgggttccgctggcttccggggtcttaaagattggcgagaccgttaacctaggttattacacccagcaaaccgaggggggcgacgacgataaacgggtgatctcttatttaaccgaaattgccgacaacgtggtcgataagtacggtcagcgcgttgacgtgacgaagttactggaacgcttcttgttcccccgcttcatgcacgggaccctaattcggaagttatccgggggtgaaaagcggcgcctctacctgttaaaaatcctgatgcaacaaccaaacgtcttactcttggacgaaccgacgaatgacctagacatcggcaccctgaccgtcttagaggattacctagacgattttagtggtaccgtgatcacggtctcgcacgaccgctacttcttggatcgggtggccgacgacctgttgattttcaaggggcaggggcaaattgagcgctacaccgggcgttttaccgattacctagctaatcaggttcaaacgacggtcccggctaaaaaggcgccggtagagaaaaagctggttgccaaacaagcggagaaaaaggaaaaaaccaagttgacctacgccgaacaactggagtgggaaaagattaacgaacaaatcgaccagttagccagtcaacaagaagagattgaaacggcaatggccgcaaatggtgataactacgagaaactggctaagttacaggcccagttaaaccaggttactaaggagctcgatgataagacggcccgctgggaatacctaagtgattacgtggattagagttgccggtaatccggttgagatctgttacaattagacccaattgaataaaaggagcgattgcaatgacggtaaatcataatgaagaacagtacctagacctggcgcgccacgtcctggaattcggtgaccaaaagggggaccggaccggaaccggaactaagtcggtcttcggctaccagatgcgctttaacctgcaggaaggtttcccgatcctgacgaccaagaaggtggcctttgggctggtcaaaagcgagctcctctggttcttgcgcggcgacaccaacatccgctttctcttggaacacaaaaaccacatctgggacgagtgggcctttaagaagtgggtcgaaagcgacgagtatacgggcccggacatgaccgactttggccgccgttccttggtggatgccgcatttaacgaagagtacaaaaaggaaaagcgggccttttgccagcggatcttagaggatgacgactttgctaagcagtacggcgacctaggtttggtgtacggctcccagtggcggagttggcaaacgccaaacggcccggttgaccaaatcaaaaaggtgatcgagcagattaagaccaatcccgattctcggcggttgatcgtaacggcttggaacccggccgacgtcgataacatggccctgccaccgtgccacaccatgttccagttttacgtgaacaacggcaagctgtcttgccagctttaccagcgcagtgccgacatcttcttaggggtaccgtttaacatcgcctcttacgccttactgacccacatgattgcgcaccagtgcgggctggaagttggggaatttgtccacaccttgggggacgctcacatctacttaaaccacctcgatcagattaaagaacagctcagccgcccagttcaccaggcaccgcagctgatcttgccggcggaggccaagccaattgacgagtaccaaatggaagacatcaagctggagggctacgaacacgaagacgccattaaggccccggtagcggtctaaggaggaacagcatggttaagattgcctttatttgggcggaagatgaggcgggctggattggcaaggacaatgacatgccctggcacctgtcagccgacttaaagcactttaaacacctcaccagtggtcacccggtcatcatggggaaaaacacctacttgtccttggggcggccgctacctaagcgaaccaacatcgtcgtgacccgacaaacgacgccaattgaaggagtcaccctggttaacggggtcaacgccctgaccgacttgttagccaattacggtgaagacgaggaggtcttcatcattgggggcgcccacctctttgccagtaccatgtctttagcgaccgtcttgtaccgaacggttgttgaaggagaccaccacggcgacgtaaaaatggcgcccatcgactatcgcacctggcaaaaagtcgctgagcgccatcttcaagcgaccgagtcggacccggcctgcacctttgaaaagtgggtcttaaacgtaaagcaaaattgaaaaatacatcaggatcgtgccacctaaaacgaagaggtgccagatcaagtgggtgtattgggtgggaaagctgtacaaaactgcgcccagcgtgaaggtaatcccaccagccaaaagtaagccaaagccaaccggccctagggcgtggtaaagtgggatgatggcaaacaagcacatccagcccatgatcacgtaaatgaccgttgaccagaagctctttttgtttagccacagcgccttgtaaataacgccgccgatggccattaaccaaatgaccgttaaaaggctgatcccaagccaccctctaatcgccaccaggcagtaaggggtgtaagaacccgcgattaaaaggtagatcatggagtggtcaaagacttgaaagacgtggcgggcccgggtgaagatcagcgagtgaaacagggtcgaggccaggtaaaagagcactagaacggtaccgtagataataaaggccactaacttgagcgggctgtgggcattaacggcggtaatgattaaggcgatcatccccacgattgacaggccgacgcccagcccatgggtaacggcgttgccaatttcaattaacagattcggttgttgacgatgcatgatggactcctttggggcaaggagaagcagtgaaatcaagggtaacttttgttatactgatttacgaaggcaaactcctcgcaagtttgtgatattatgataacgtaatctagttttaaagactagattaattataccaaatttttcaggaagagtgataaattccatggcaaagattaaaattgtggcggactcctccgccggcttaaccgaagcggaaatcaaagagcacgacatcacgatcatccccttatccgtgatgatcgacgggacggtttacgttgaacgcgaaacgattaccaacgaccagttttccgacatgatggaaaaggccagctccttgccaaagacctcccagccgccaatcggtaagttcaccgaggcctttgatcgactgggcgaagatggcgccgaagtcctctgtgtctgcatgatggaatcaatttccggtaccgttcacgcagcggagcaggcggctagtttgactaagacaccggtccgggtgattgattgtcaaaccaccgaccgggcgatggccttccagattttagaggccgctaaggtaatcgaagccggcgggaccatggatgaggccgtggcgaagatgaaggaagtctttgaccaccacaagctgtacctggcgattgacaacctggacaacctggtggccgggggccggatttcccgctttgccggtacaatttctagcctgttaaacattaaggtgatgctggaagtagcgggtggtcaaatccacatcgccatgaagggccggggaattaaggccatccacaaagaatgggacaagatcttagaccagatggctaatggtcccaaggtgaaagggatcgggatttcccacgtcaaggccgataaggaagttgcccgcttaaagggaaaattaaacgagttgttcccggggatcgaggtcacggtgcgggaaacggtgcccgtgatcgccacccataccgggttgggcgcttgctgcctgatttactacacggaataacggtgggtggtaaccaacccattcgacttactttgctattaggtctgcggttatttcctactttccaatcaaaaaccggccaattacgcaaccttggttgcgtaattggccggtttgttgatttaaggggagcttatagctccgggttcatagatgggttggttaagaagcggaagcgaatgatgtcaccgtggtcttgtaagagttgacgtaagttggcgatttccgcttggctgagcacactgaggtcggtgttgatcagggcgtaactgtagccgtttttggcgttgctcgtcatttccttgaccgttaagccctggtcagttaaaagttggacgaaatcgagccacaggttggctcggtccttgtaaaagagggtgattcggtggggggtgtcaaaggggaggtcgacgcgcggaaagttgacggaggtccggacgctaccgttctctaagaagttaagcaggttttgtaaggccatatcggtgctaaaggtcagggcctcttcggtgttgccaccgatgtgagggaggagggtgacccccggttggttttgcaggtcgctagctggaaagtcactaacgtagccggccagctcgccattggccagtgcttcgaggaggtcttggttattaacgatttcgccgcggccaaagttcaggaggtaggcgtccggttttagctgttggagccgttcccggttgatcaggccggtagtttcttcggtcaggggtagcatgacgaccacaaagtcggctaatgacatgacctcttcaattgtcggtagttgaacgacgtgggggaggttcttgggactacggttataacccaagacttgcatcccgaggtggtaactagcttcggcaacccgttggccaattgccccgaggcctaaaatcccaatcgtcttcccgtataattcgcggccgataaattccttgcgcgtcgcctcggccagcacttggaggtcagctcccggttcggccgtcaggtctttgacggttgcaatcgcccggtcaattgggcgcacgcaacggaagagagcttggatgatcaattccttaacggcgttggcgttagcaccgggggtgtttaagacgacggtgccgttttcggtgcaggcgttgacgttgatggtattggtaccaatcccggcccgggtgatcgccagcagttggtcgttgatcagggcatcgtcaacctgggagctacgaaccaacagggcgttcggagcgtccgtgtcagaaatttgaagtagatcgtgggcaaaatcgcttaattcaaatttatcaattgtttttacttggtacataattgctcattcctttaagatggattataaagtaagtataaaccaaaccgaaaagagggaattactaaaatgcacatcgaatttccaaagttaaagcgagacgaaccaaccctgggtgaaggggtccaggttaacaagaccacctttggccagtgggtggaactaggcgaccggacgttagccgataactgcacgattggggactacacctacaccgggcaaaattgttacctgcaaaacagcgacttgaagcgtttcattagcattgccgcccaggtgcggattgggccaaccaatcacccttacaaccgggcttcccaacacgtctttgcctacaacgggacgacctttggctttgaccagcccgacgttgagttcttggctaaccgcaagcaggtccggaccacgattggtaacgatgtttggattgggcacggtgccatcattcaagcgggcctaacggtcggcgacggggcggtgattggctccggggccgtggtcacccatgacgtggaaccctacacgatcgtcggcggggtctcggccaagaagatcaaggaccgcttccccgacgagattaaggcggacctagaaaagatcgcttggtgggattggtcacgggaacaattagaggctaactacctcgacttccgtttaccaattgaggaatttgtccaaaaacaccttcacgcttaatttaagcggggccgggaagtgtgctacaatggttagcgactaacctttggtgggcacggtgatgtctcaccgcccccggtaaaataagggggcgaccaaagcggccgtccctttttaatggaggaagcgttttgagcaagaaagtatggcgctggttgttgttaattgtcgccctgatcgccattggtggtggggcagcttggtacttacgtggtgaaccgtccctcgtcgccaaccaagagcaacaacggattttaaagaagaaaattctcttggttgccctaggggactcgttgacccacggccagggggatgaaaaaaagcagggtggttacgtggggcaaattaagacccgcttggaagataagtatggcaaccaggtgaccaccgaaaactttggtgtcaccggggaccggtccgatcaaattaaggcccggctcgatagccaaagggaaatccaaaccggactcaagagcgccgacgtgatcgtgatgaccgttgggggcaatgacctgatgcaaacgttagaaaaggccgccttttcgacgtcctcggtaacggtggaaaaagacgtgaatgcggcgggtaagctttatcagactaagctcacggccctctttaaagacgtccgaaagtataacccaaacgcccagcttttcgtgttctcgatctataatcctttttacacctactttccgaacgtaacggtgatttccaagtcggttgccaagtggaaccagttgactaagcggctggttgccaagtaccaaccagcaacctttgtggacatcaaccacaccctttcttatggtcaatacacgacccgggcggcccgccagcaattggtcagtcaggcgaaaaaatccaataacgatcagatcacccaagcggcggttcttgcaatcatgaacaacaaggaccataacctaaacaactacatttcgacgtcagataacttccaccccaatcacctgggttacaccaagatgactgagaaactctttgacgcgatggtgaaaaataacaactttgagtaccaaacgaggtaggatatgcacagacaaccaagaaaacggaacccgtggaagtgggcttttctcattttggccactttggtcgtgattttcattggggtggtgatcgataaaacgaccgccccggtctccgttcccaaagagatcagtgccaccaaacaggcggacacctcggtggaggtaaccttaaaccgcaagcaagttaacgccctgtcggctaactacttgaataagttcttaaaggactccaaggtgaagtaccgcttcgtcgtcggtaaaaagtacgcgaccgtcattggccggactaaatttttgggggcaacggtgcagttttctttgaacttcatcccgcaaaaaactagtcagggtaacgttttgttgcgcgccaagggattagcggttggacgactaaacctgccgatccggtttgtgatggcctttttaaagaagaactataagctgccccagtgggttagtttaaacgtgaaaaaagaaacgatcctgctggatttaaataagtacagccaggataaatccgtgcaatataccgccaaagaaatcaacatgaccaacggcaccttccgctttttgattacgattccaactaaataggaggcccccatgtaccgcgagagtttttaccactttttgatgacccaacgaaaccccaaccaacccgatgaggtggagcagtttgccaataacgccttttatgactccgcctttcccaagcagtcacaagattttgacgagatttctaagtacttagaagaaaacgccgagtacctaccgtcaatgctgatctttgatgacgcttggcaccgctacgaacagaagatgaattaggaggaaaatgatggcaacgattcaatggttccccggccatatggccaaggccctgcgccaaattaaagaacaaatgcccttagtcgacatcgtctttgaactggtcgacgcccgcgttccgtattcaacgcaaaacccggagattaaccggatggccggcgacaaaccccgcctgttaatcatgaccaaaaccgacctggccgacccgacgacaacggcccactggatcgactactttgaacaaaacggtcaaccggtcttggcgctcgattccagggcccaccaggttgctaaacaggtgaccgtaaaggcccaacagattctaaaggaccagttggccgccgagcgagcaaaggggatgcgaaagcgggcgatccgggcgatgtgcgtcggggttcccaacgttggtaagtccaccttgctcaaccacttggtgaaaaaaaacgttgccgcgaccgggaaccggccaggggtgacgaccggccaacaatggctacgttcctcggccgacttggaactgttagacacccccggggtcttatggcctaagtttgccacccaaacccaggccaagatgttggccctgtccggggcgatcaaggactcgctgtaccctaaagacgacgtggcgatctttgccctggattacttacgggcccaccgtacccaagagctcatgacccgctaccggttgagcccggctagtcttgaagacggtgtgaccaccccagacctgttgttagaaatcaccaagaaaatggggatgaaagacgattacgaccgggccagcgagcggctgatttttgaaatgcggcggggtaaattggggacctttacccttgaagaccccaccgatttggaagcgggggacgaagatgagtaagcaatcggtggcccaggtcagggcgttgctttcgtcaatcaccgatccccaggacccccgactggcagagttcaaggacgacccgcgtaagggcgttcaggccgcgttaaaccagttcgccaagcggctggaaaaaagggccgaggcgcgggccgcctttttgaaccgcttccgctacgaaaaccagctttggcaggccggtcaccagtacgtcgccggaatcgacgaggtcgggcgtggcccactggctggcccggtggtgacttgtgccgtggtcttagacagccagtttgacctagttggcgtgaccgattcaaagcagttaagccgccacgagcgcgaacagttgtacctgcggatcctcgatgaagccgttgaggtttccctagcggtcagtccggctcaagaaattgaccggcttaacatctatgcggccacccaggcggcgatgattcgctcggtcaaagcactccaccaccagcccagccacctgattgtcgatgcggtcccgttagacattccggtaccccaaacgacgttaatcaagggggatcaaaagagcatctcggtggcagccgcctcgattgtagctaaggagtaccgggaccacctgatggcaatttacgatcgtctgtatcccggctacggctttaaggacaacatgggttacggcacggcggcccacctagctggcttagagcagctgggggcctgcccgatccaccggcggaccttccgaccggtgccagattacgtcaattaatttcgtcaccattaccgattcctccgtacttaacagtagggaggaatttttatgcaaccacgagaatttatctttcgcttaagcctctgtcccggcctcggtccgttaagccgggtgcgcctgtggcgagtcgccgagcaaaactactgctttgacaatttggaattactcaccagccagtcgcagattacaccacgggtcaaggaaagcttgctaaaaaactgggcgagcccctatttggaccggttggttgaacaaaattaccgggtcccccaaattaccctgctggatcccgattacccagcaatcttacgggaaatctactgcccacccctggttttgtactaccagggcaaccgggacctattcaaaatgccggccctagcggtggtcgggtctcgtcaggcaactagctacggcttcaccgtcttagagaaactgattcccagcgtcgttaaccaccggattaccattgtgtcggggctggcgagggggatcgattcgcggagtcacgagcaggccctggcaagcgggggcgccgtgatcggggtgatcgggaccggcctggaccaaacttacccccgatcaaacggtgccttgcaggcccaagtggccgaccaaggcctcttgttaaccgagtaccccctgcaaaccccgcccttgccgagccactttcccgcccgcaaccggatcatcgccgggctttgccaaacttgtttggtggtggaagcaaagcagcagagtggcagtttgatcaccgctaacttagccctgcaggagaaccgcaatgtttgtgcggtccccggccccattaccagcccgacctcgcttggcaccaacgaattaattagtgaaggggcgcaaccaatcttaaacagcaaggatttgttagcggagtttgacccctggtttgaagccgaagcttagtttaactttgcatctttcatttgacagcagggcgcccgtgcattaataataaatggaatagattattaaatgacaggagccgatgagtttggcaactaaacaagaaagcacaacaaagaaaaaaaccacccggcgcaaagttagccggactaaccaaaagaagctggtcatcgttgaatcgccttccaaggccaagacgattggtaagtacctcggacggacttacaaggtcgtcgcaagcctcggccacgtccgcgacctccccaagtcgcggatgggggtcgatatcgaccacgattaccaacccgattacatttcgatccggggtaagggggacgtgattaaggaattgcgcaaggacgccaaggcggccaaggccgtctacctggcttccgacccggaccgggaaggggaagccatcgcttggcacgtggcgaacctcttgaagatggacccgaccgaaaagaaccgggtcaccttccacgaaatcaccaaggatgccgttaaagaggcctttaaagaaccccgcacgattaacatgaacctagtggacgctcagcaggcccgccgggtgctcgaccgcttagttgggtactcgatttcgccaatcctctggaaaaaggttaaaaagggcctgtcggcggggcgggtgcaatccgtcgccttgaacctcatcatccagcgcgaaaacgagattcggaatttcgttcccgaagaatactggacgattgacgccgacttcaaaaagggccgagaaaagttccaagcgagcttctacggccaaaacggtaagaaggccaacctgaagaaccaagaagccgtccaagcggttctacaacaactcgaccgccagcaggacttttcaattaccaaagttgaccggcgggaacggcgccggatgccgcaaccaccgtttaccacctcgacaatgcaacaggatgccaaccgccgtttaaacttccggacccgtaaaacgatgatggccgcccaacaactgtacgaagggattaacatcggccagggcgccgccgttgggctaattacctacatgcggaccgactccacccggattgctggggtggctaagcacgaggcttccactttcatccacgaacactacggggcggaatacgccgccaccaagccggtcaaggggaagctacaagaaggggcccaagatgcccacgaagcaattcggccgacctcagttaaccggaccccggccgagatgaaggagtttttgacccctgaccaatacaaactctacaacctgatctggtcgcgctttgtcgccagtcagatgaccccgcaagtgacggacacgatggccgtcaccatcacccaaaatggggtcgacttccgtgccaacgggtcgaaggttaagtttgatggttttactaaggtctacaaggggagccagggtaaggataatatcttacctaacctagaagagggcgacgccgtcaagatggtcgccgacaatccggcccaacatttcacccagccaccggctcgcttcaccgaagccgccctggttaagacgctggaagaaaacggggttgggcgcccgtccacctacgcgccaaccttagatacgatccaacgccgctactacgtcaagctagaatctcgtcactttgaaccaactgaacttggggaaatcgttaacgatttgattgccaagcagttcccggacatcgtcaacgtcaagtttaccgccgaggtggaagactcacttgataagatcgaagagggcaaggaaaactgggtgcaagtcgttgatagcttctacaagccgttctcaaaggaagtggccacggccgaagagcaggtggctaagattgagatgaaggatgaactaggcgggtccaattgcgagatttgtggtgccccgatggtcattaagatggggaagtacggtaagttttacgcttgttcccgctttccgaactgccgtaacaccaaggcgatcgttaaagacaccggggtcgaatgcccactttgccaccagggaacggtggtggaacgtaagtccaagaagaaccgggtcttttacggttgttctcggtacccggactgtgacttcctgtcttgggaccggccaattggtcgcgactgcccaaaggatgggcacttcttggttgaaaaaaaggtcaaggggggcaagcaagtcctctgtccaaacggggattacaaggaagaagttcaaaaataatctaattgacgcctgcctaagatggtgggcgtttttagacgatttttacgaaagggtttccatttccgattttcttgcgatatttactatgttataatttttttaaagttttgtcgggaggggatcatttggtaatggatgaagaattagaagcggcctttttaaaggaacaggaaagacgactcgccgcatcaaccatcgcggggtacggtcgtaacctcaactttgttcgccggtcttaccagggcgagtggccggggtgggtccacctttcgaccgcccaaattcgcgcctttttcatttgccggcaaaaagagggggttagcgtggccactacccgttatcaggccacgaccctccgccggttttaccactacttactggagcaggggttggtggaccaaaatcccctggttgggatccaatttgacgaggtcggtggtaccaggggcaacctgcccaactaccaattgttgatggaatcgatcgagcaaaacagcaagcgggcaaccctcttagaacgggtcgccacctacttggtaatcgagactggcatgcgaacgggcgagctaatcgccctatgttgggggcaggtggacgtaaccatgaaaatggtcctgattaaaggcgaggaccaaaccgagcgctacgttcccttgcctgatgacctgttaggcttattaagccagttagaagcggcttatgcgacgccaccgacggtcagggaacgggtgctgacgttggcgaatgggaaaccggttagccgttcttgggttgaacgaaccgtccgccgggttagcggaggcgctacgcccgcgaacctacgccatgcctatttgaacaaggtcgtgttagaacagcgcctggaagacgccaaccggttggcgggccataagaccctagtggccacggcgggttaccaacaagggcaggttcaggatttgaagaagaagtatcaacagtatttctagagaggaagagcaacgatgattacgatcacaaacgagcgtttaatggtccaaattgaccccctgggggcgcagatgcacagcattaagcggcggggtgaggacactgagtacttgtggcaaggggacgcccagtcctggtcacgccaggccccggtcctgtttcccttcgtagggcgtttgaaagatgatcactacggctttgaaggacgagattttcaccaaacccagcacggctttgcccgcggtcgggaatttaaactggttaaccaggccgctgatttagcggtttttgagttagaaagcgatgaacaaacacggaccgtttacccctttgaattccgcctgacgatcacttacgctttggtggaagatcagttagtgatcagctaccaggtggctaaccccgcaagtgagcaggtattacgctacgctttgggggcccacccgggattcaacgttccgttaacggcggctggtcagtttgaaacggcgactttgacggctgacccggctaaagtttacccccaaattcctttggtggggccatacagcgaccttggtcaccccaaggaactggacgcccggcggccaattcagttaaaccacgacctctttgaccacgacgccttagttttcgccccttatggtgccgacctgtccttaaccctaaccgaaccggagagcggccacggggttacggtgctcaccagtggcaaccccttcgtgggggtttggtcgcaataccctaacaccgggaacttcttgtgcatcgaaccgtggtggggcttagccgatggggttgatagtgacggtcaattgacccataagccggccatgaaccagttagctccgggaggcgttgccaactaccaattcagcatccgtcccttttaaatcagtaactaaaaaaagaccttttgcccagggaaacacctaggagaaggtcttttcaattgccagtctacttgcggttcttgaggtagtggcccaggccgaaggaaaccatcgattcttggccgtggatgatccggttgatgttgctgcggtggcggtaaatgaccaccgccgttaaaataccagccacggtcgctaagatatagtcgtgcatcaccagggcgatcacgaagatgctggtaatcccaatgattgaggccgccgaagccatcgaggtgattagcaacaccgccacgaagatggcggaggccaggagaaacattggcggattgtaggccaagaggatcccagccgaggtggccacggccttgccgccgtggaagtggtcgaagatggaaaccgtgtgaccaagggaagcaaagatcccaatcaacaaagggttgatgttgctgtggaagaggtagggttggctagccgccaaggtcccctttaaaatgtccatgaccaagaccaccgttcccgccttgggaccgaggacccggtaggtattggtggtgccaatgttaccactgcctaactggcggatgtctttattatagaagtgttggccgatccaaagccccgaggggattgagcccagtaaataggcaatgacgaccatcagaataatttttagcatacagacgctcctttgaattatagctcacctatcatagcaccttttactaggttcgaccataagggaacgggtgtttgattaaaatgggcgaggtgtgctacactaattaagtgtaattcagctgggcgccggctggtcaattcaaaagatgatttgaaattgcggccggagttagctatgataaaaaatcgaatgcaaaaatgcaaatccaaaatgtgagggggcccctttgtggcacaagaagaatacaagtacgacgcatcctcgatcaaaatcctgaagggactggaggcggttcgcaagcggccagggatgtacattggctcgaccgatgcccacgggcttcaccacctagtgtacgaaatcgttgataacgccgtcgatgaagccctgtccggttttggtgacgagatcaacgtgacgattgaaccagacaacgccattacggtgcaagaccatgggcgggggatgccagtggggatgcacgaaagcggcaagcccaccccggaagtcatcatgaccatccttcacgccgggggaaaattcggccaagcggatggctacaagagctccgggggtctgcacggggtcggggcctccgtagttaacgccctgtcttcgaagttaaccctaacgatcgtgcgggaccacgtccgctaccaagagaagtttcgtgacggtggtcaaccaatcggcaccctaaaggaactgggcaagacccgggaaggatcgggaaccacggtcacctttaaaccggatcccacgatcttttcgaccaccgtttacgactaccaaaccttggcaaggcgcctgcgcgagtccgccttcttactcaagggggttaagatcaccctgaccgacaagcgggaaggaatggagcaagaagaggtctttcagtttgcaaacgggattgaagacttcgtggcctacctcaacgaagataaggacaccctcgggaaggtcttttcctttaccggtacccaagacggggtcgaagtcgacgtggccgcccagtacaacgatgggtacactgaaaacctactgagcttcgtcaacaacgtccgtaccccgggtggtgggacccacgaggtcggtttccgtggtgcttggaccaaaacctttaacgattacgcccgcaaggtggggcttttaaaggagcgcgataagaacctggaggggaccgacgtccgagaggggctgaccgccgttgtgtccgtccggattccggagcggatcctgcagtttgaggggcaaaccaaggggaagttagggacgccagaggcgcgcaagattgttgatacgatcgtgtccgaacagttaggctacgccctgatggaaaacggtgacctcgcccagtcactaattaaaaaagccttacgggcccggcaagcccgggaagcagcccgtaaggcccgcgaccagtcccggtctggcaagcgtaagggacgcaaggagcgtaacttatccggcaagttaacccccgcccaatctaaaaacagcgccaaaaacgagctgttcttagtcgaaggggattcggccggtgggagtgccaagcaggggcgggaccgcaagttccaagccatcctgccactgcgcgggaaggtcttaaacaccgaaaaggccaagctcgatgacgtgatgaaaaacgaggagcttaacacgatcatttacacggtcggggccggggttggaaccgaatttaaggttgaagacgctaattacgacaagatcatcattatgaccgatgccgacgacgacggcgcccacatccaaatcctcttattgaccttcttttacaagtacatgcggccaatgattgaagcagggcgggtctacattgccatgccacctctgtaccgcctacaaaaagggcgcggtaaaaacaccaagatcacctatgcttggaccaatgatgaactgactaagttgaccaaaaagggcagcaaggggacgtctttgcagcgctttaaggggctgggggaaatgaacgccgaccaattatgggagacgacgatgaacccggaaaccaggaccctgattcgggtgcggattgaagacgccgaattagccgaaaagcgaattaccactctaatgggtaacaaggttgaaccgcggcgggagtggatcgatcaaaatgtccacttcaccattagcgacgaccaagaagcggatgccttagtggaagctaagggccaagtgagccccacggtgacgacttggaacgagtaaagaaaggatgacgccagtggctgatacacgcattgaagaattaaccctcgaacaaattatgggcgaccgctttggccgctactctaagtccatcattcaagaacgggccctccccgatattcgcgatgggctcaagccggttcagcgccggatcctgtttgccatgaacaaggatggcaatacttacgataagggctttcgcaagtcggccaagtcggtcgggaacgtgatggggaacttccacccccacggtgattcatcgatctacgaggccctagtccggttaagtcaggactggaagttacgggaacctttaattgaaatgcacgggaataacgggtcaatggacggtgacccggctgccgccatgcgctacaccgaggcccgcttatcaaagatcgccgggcggatgctcgaagacattgacaaagacaccgttgaaatgactttgaactttgacgacaccgaaaaggaaccggtcgttttacccgcccggatccccaacctcttcgtcaacggggcgaccgggatttccgccgggtacgccaccgaaattcccacccataacctaggcgaattaatcgacgctttaatttacctgttggcccacccggctgccagcctcgatgacctaatgaagtttgttcccggaccggattttccgaccggggcgattattcaaggaaaagacgggatcaagaaagcttacgaaaccggacgcggacgagtagttgtgcgggctaaaaccagcatcgaaacccttcgcgggggccgggaacaaatcgtggtgaccgaaatcccctacgaggtcaataaggctcagttaatgaagcggatcaccgacctgcgcttaaacaaaaaggtcgaggggattgccgacgcccgcgacgaaaccgaccggaccgggttaaggatcgccattgagctcaagcgaggcgttgatgcccagggggtcttgaactacctactcaaaaacaccgacctgcaaatcaattacaacttcaacatggtggccattgatgaccaacgtccggtccgggtggggctaaagcactacttggcttcttacctcgcctttcaaaaggaggtcattactcgccggacccgcttcgacttacggcgggcccagagccgcctccacatcgtcgaaggtttaatcaaggccctatcgattttagaccaggtgattgcgaccatccgggcctccaagaaccgcaaggacgcccagcaaaacttggtggcggcctacaactttaccccgacgcaggcagaagcgattgtcgccttgcaactctaccggttgaccaacaccgacgttaccgccttagaacaagagcaagccaagttaaccgagcgaatcgaaaacttcaagcggatcctgacggacgaaaaaaccttggaccgggtcttgaaacgggagatgcaggcgatcaaaaaggaatttgccaacccacggcggacccagatcgaggacaccgtccaaaagttgactgttgacacccgggtgacggtcgccgatgaagacgtgatcgttttagtgtcggcggctggctacatcaagcgctcgtcgattcgttcctttaaggcctctgaagtgggagataacgggttacgggaagacgattacccactcctcttggagcaaacgaccaccctgagccacctctacatgtttaccaaccaaggccgctttatttaccggccggttcacgaactgaccgacgcccgttggaaggacactggtgagcacctatcgcagacgattgacttggacgacgatgaggtaatcgtcaaggccatgctgttggataagctcgacttaccagggaccttcatttttgccacctccgatgggcaagttaagcagagcgccctaagtgattaccaaccgggttcgcgctacaagactcacgcctcggtagcgatcaagcttcgtgaaggggcacaggtcgtcagcgtggactaccttgaacctgaacaagccggccagtccgttctcgccattagccgggagggttacgccctgcggtttgccgttgaagacgtgccggtcactggggttcggaccgccggggttcgggccattaacctcaaggaggacgaccaactggtggggatctccttggctggcgacggggaccacttagggctggtcacccagcggggcgccttcaaggaaatggcggtcagcgacctcgaagtcggcgcccgggcaaggcgggggaacctggtcttgcaccgcttgaagaagaatccgcaccaagtggttgcctttgttacccaccccgctgattttaccggcgcccttgagattatcaccaaccgcccggccttccaggacgttttagtggctgaacaacggttggggaccgcccagtctaatgggagcttcgtggttgacacggacacccaaggcgttccggtcaccctgcgcgaaaagctgattgccaaggtgtcggagggcgaagaaatcgaattactgtaaaccacccctaaaaacgcctataataatggtgtaatcgctcaatttagacgagaggtgttaaacatgaaaaagaactttaacttaaaggccgccatcaaggcggggacggcagcggggctgatttccgggctggttaaattaggctgggaagacgtcttaccaccacggacgccggaacgcaacgccaccaacccaccccaacgcttgttagagcaactggggatgtcaccgagcctcacccactcgacctacacttattctgaccaggaaatgccgtgggtatcgtttattgtccacttcggcttttcggtctcctttgggatcatttacgaggtgttggtcgaaaactctcagtacctaaagaagggctacgggaccatcttcggcttggcggtctgggtggccttccacctcgggattatgccagcaatggggaccgtcccgtcggcgaaggaacagcctaaagaagagcacctgtcggaagccttgggtcacatcgcttggatgtggactaatgacattgtcggccgcgaactttaccggcgcctaaccgaagccaagcaagaacaaaaggcctaggggtgtagcggtagcttttttgaaaaagccatgcacgccccggggctgcatgctaaaatatgtaatatcagcgaagtgaaattcgttaaatttgaggaggaatcctagacatgagtaaagagttagtttttggacaccaaaagccggatacggacacgatcgccgctgcaatggccttttcttactaccaaaaccaattggggtacgaaacggaagccgttgccctcggcgaagtcaatgacgaaaccaagttcgccctgaataagttcgggatgcaagcaccacgggtggttgaaacggtggctaatgaagttgacgccgtaatgttggttgaccacaacgaaccagcccaaagcgttgccgacttggatcaagtaacggttacccacctgattgaccaccaccgtttgaacggctttaacaccgcccaaccgctgtgggcaaccctacggccgtacgggtgtgtttccacgatcatcacggaactgttccaagacgcccacattgacattccgcaaaacctggccgggatgatgctttcggccatcatttccgacacgctcttgctcaagtcaccaaccacgaccgaccacgatggggaagccgttaagcacttagctaaggttgcgggggttgattacgaagaatacggcctgcaaatgttaaaggccggcaccaacctggctgccaagagtgacgaagcaatcgttgacggcgacgccaagacctttgaactggcggacagcaaggtgcggattgggcaagttaacacggttgacttagacgatgtcttctcccgccaagagggaatcgaagccgctatgcaagccctgatggacgaaaacggttacgacacctttgttctgatcgtgaccaacatcttgaacagcgactccgacctcttggccctcggtgccaaccttgacaaggtggaagccgcctttgacaagaagttaaacgaccaaaagcggatgaacctgccgggcgtagtttcccgtaagaagcaagttgttccaccgttgactaaggccttcgaaggctagtagtacattaaaatgaacctaggggcttggagaacgaggcattctccaagccccttgttcgtttgccgctttttcggtgcgcgagccgggaaggacctcggtggttggtgagcattaaagttgtgcttacttaaaataagggtaaactaaagacaattgcatggatgcctgaacgaataaaggagtgattagcgtggatttgacttttactgaggcggcaaaggaacgggtggcccgttacctttcccccgacaagaagattatcttagattacgatgacggtgtaggtccgttttccaagctgggcgattgttcgcttgcggccaactacaagctgatctttgtggataaggatgctgatttaccggactttgacgcccacttcccgtccaacctcggtgacgtgtactacaagggctttgacgccccacaatacaccgacgggatggaactacgttttaacccgacttacttcgtgatgtccttgacctcgccacacggggttttaactgatagcgtggagatcctcgacgttaccgaaccagtcaacgccaacgccacccagggcacgacccacgattgctaggaggacgcaatggaagacaagcaagcagcgctaaagaagctgacgccgacccagtttgcggttacccaagaggcggctaccgaacgccccttcaccggtaagtacgatgatttttatgaagagggattgtatgtcgacgttgtgtcgggggaaccgctcttctcgtctaaggataagtatgacgccggctgcggttggccgtcctttactaaaccggtcacgaagctcaccatgaaccgcgaccagtcgtttggcatggaacggactgaggtgcgctctaaggaggctgattcccacttgggtcacgtctttaccgatggtccggtcgaccgaggcggcctccgctactgcatcaattcggcggccctgcgcttcatcccggttgctgagttagaagaagccggttacggtcagtaccgatcattgtttgaatagtacaggagtgaaagggaactgggttcgtttggcccagggccctttttaaatttcagctactggaaaacggtaggcctaaattaactagccctttccttttgacccggtcagcgtataattaacaagaaataatgaataaagggggaccgttgatgattaattttcgtcaagcaacgctagccgacttaccaaccattgtcgcaatctacaaccaaaccattgccccccacgcggtgacggctgacatggagcccgtgacggtcgaacagcggcgggggtggtttaactcctttagcgacgatcacccgctctgggtcgttgaagatggtggccaagtgattgggtgggtgggtctggagcccttttatggacgggccgcctaccgccacaccgccgaggtggcaatttactttgaccaggccgttcgccaccaggggttaggcactaaggcgctggcctttatggaaagccaactagccgcctgcgagatcacggcggtggtcgcttacatctttggcaccaatcaggctagccaggccctcttcaagaagttcggctaccaaaagtggggggcctttccgggggtggctagcttcccggacaaaactcaggacctggttttctttggcaagcgttacgatgaggaaaaaaatgatgagtaaacaagcagattaccaattactttaccagcaagccttagccctctttgaaggggaaaccgattggatcgccaacgccagtaacctggcggccctcctctataacggcttagctgacgttaacttcgccggcttttaccgcgttcaggacggtgaattgatcttgggtcccttccaaggacaggtggcttgcgtgcacatcgcctttggtagcggggtttgcgggactgccgccctaacggggaaaacccaattggtgaaagatgtccaccagtttgccggccacattgcctgtgacgccgcctcaaactcggaaattgtggtgccaatttatcagggtgacaaactctggggggtcttagacattgacagccctaagctcgcccggtttgatcaggaggaccaagccggtctggaaaggttagcacccctctttttgcccggcgcctgattgacaaccggcgggggactgttataattgaacaaacgaaaatacgaaagtctttaacgacgtccagagaggcggcgaagacgacaaaggatgggtgtagtcccgtcatttagaatcctcgccacccgggcggggatttttttgaaggaggacaaaatggaaacaaagcaaaaagaggtcatgatcgagcggatcccaatggaagcgcgccacactaactggtgggacatgtttgccacctgggtgggggccaacgccaacaacgggacttggtttgtcggtggggtgctcgccgcctgcggttttgccgtcgccatgaacgtactggtgatttcatcggccttatcctacgtctttttgagcctggttggttatatgggctacaaaactggtctgtcgacgatgagcctgtcacgggcctcctttggcgagcgggggagctacttaccatccctggtgaacattacccaattcatcggctggacggccgtcaacaccttcatcgccgcccagtcggtcgggttaatcttaacccagctgctggggtggccaagtttcggtcaacccgggggtgccaagggccttgtggtggggatcatcgtgatgagcatcttgcacatcctgtcggtgtcggccgggtcccgttcgattcagatgattgaacggctgggcattattttggtgctggtctttgtgatttgggaatcggtggccgtcttcaagacggtctccttgaccgaaatcgctcactggcaagtaccggccaaggcgagaatgacgaccggggcggcaattgactacgtggccgccttcaacttggcctgggtaacggcgggagccgacttcacccgctttacgccgagccgggctaattcggtggtctctcccttcgtcggcgccatggtgggggtgctctggtttgccttcatcggcctgatttcaacgatttcgattgccatcacttccggggcctacaacgccaataactccgaccctagcacgatcgcggccaagctcggcctcggggtgatcgccctgttggtaatcgtcttgacctccatgaccgccaacgccgttaacctcttgggggcggggtcggccctgtccaacatcttccccaagctaaacctgaagctcgccctctggatagtggtgattttggcaacggtggtgaccttaatcccgatgtttgtcggttcttttttagacaccttcgaaagctttctggattacgtggcgatggtcctcggacccacgattgccatcatttgtaccgacttttactggaaggcaaagcgccactaccaggtcgaagaatttggccgggttaaggggcgttattggtacaagggcggggttaacccggcggcgatcatcaccttcgtggtgggggtggtcatcttcttggcctgccaaaaacaaacgttcttcgttaacacggtggggatcacctttatcgacatggtagtctccagcctcttgtacatggtcctgtcaaaattacaaaggagttaatcatgctaattaaaaacgtccacgttaacaaccaacccgaactcgttgacgtcgcgattaccgacggcaagtttaccgctattgaagccgggctaactcccaagcccggcgagcaggtaatcgaggggaacgggaaacttttgttgccacccttcattgattcccacgtccacttggatgcgactttgacggcggggcagcccgagtttaacgaatccgggaccctctttgacgggatccgaatctggagcgagcgtaaaaagtcgctaaccaaagaagacgtcaagaagcgggctaagcagacgatcatgaagatggttggccacggaatccaacacgtccgctcccacgttgacgtgaccgacccgcacctgatcgccgcccaggccctcttagaactcaaacacgacttaaaagaccaggttgacctgcagttggtggccttcccccaggaggggatcttaagcttcccgcacggcaaggaattaatggaacaagcggtcaaagaggggctcgatgtggtcggggggatcccgcactttgagttttcgaccgagtacggttggcaatcggtccacttcttaatggccctagccgacaagtacggtaagctagttgacgtgcactgcgacgaaattgacgacccaatgtcgcgccacctagaagtgctggcgaccgaagcgtacgaacggcaaatgggcgaccgcgtgacggcgagccacaccacggcgatgggttcgtataacgacgcgtacacctacaagttgttccgactcttgaagatgagcggggttaacttcgtggctaacccgctggtgaacgttcacctgggcgggcgctttgatacctacccgaagcggcgtggtgtcacccgggtcaaggagctcgacgccgccgggatcaacgtttcctttggtgaagatgacgtccaggacccgtggaacccgctgggtgatggtaacatgctcgacgccgtgacgatgggggtctacattgcccacctgatgggttattcccagttgcaagactcgtttaagtttgtgacgaccaacgcggccaggaccctgcacatcgaggaccagtacgggattgaggtcggtaagcccggcgactgcatcttattaaacggtcaggacttctaccaggccctaaaccaacacgccgaagtcctgtacaacatccgccacggacgtgttctggcccaaactaagccggccaagacgacgatccacttaaattagggcgttcggaaatgacgccgccgatccgttgaatgatctaatggtaagcggtttctttgattagacggattgtaataaaattacaaaaagttgcattttagcaacgccaagcctaaatgagaatgttataatgttgccatagctaagatgaaaggaagacgaatgtttatgacagaaactcaccaatccgttcgtactgacgccctatatatgaatcctgaccgggggattgccaccctcgacttcagtaaatactatgttaacaacttctataatctcatcaattcgaagggattagttgagatcatccgtctttacctgacctcatcgcaccacactaaggacgcaaatgggatcgaaaacgtttccgccgaagagtacgtggcgatcctaaagaaggtcttcatcaacgacgaccacgcctacgatgactttacgcctcaagaaatcctggcctcctttgaatcactgtactccttttaccggagtttcctgcgggtttcaatcactaacttcaacgacaactcggtgattacccactcctttaaggaagccgacgcccggttcaacgatttagtgatccgcaactaccggatcatcgaagaaaagctccagggctttgttaacaacgtttaccgtcaggttaacgccgggactaacgctaccctgctggttcgcgaccaccaatggccggcaccaaagggttacgaatccttgaccgacgtaaccttcattgacaaggtcatgctgcagccgccaatgctgatgcacaccaagtccaacaagcgggaaggggtcttttccgccgtagattacaatccggttgaccactttgccggccagcgtcaagaatggctgtgctacccggctaaggtcggtgaaagcctgatctttatttacttccacgtcgattacatggttaacgggctcgccctttctaacttgtttgaattggcaacggcagaagaagttgaggggcaaaagcccgatgccatcttgatttttggccaagaaaagacggcgggcgatgtatcgcactaccactacgacagcgacaacaacctttgggtcggcgaagtcccgtacaacgacaagacgacctactttggttacatgaagaagatgtgcctaaccctgcacaacttacaccaaatctacagcggcaagctgccaatccacgggtcgatggtgcggattaagttcaccaacggcaaggacaagacggtggtcttcttcggggattccggcgccgggaagtccgaatcgctagaagccctgcaggaaatcgccgatgaacaaatcgtggaaatggaaaccatcttcgacgacatgggctcctttatcctggatgaccaggccaagggcgggatctacgcccaggggaccgaaaccggagcctttgtccgcctcgacgatttgtcttcttccgtggcctttagcaacatggaccgtggggtcttcttgaacccagaacggaaaaacgcccgggtgatcatcccggccgacgcgtacgaaaacgtggtggcccaccacgaaatcgacatgtgggtgtacgccaataactactccgacgggattggggtccaccaatttgaaaacgaagaggaagccaaggaagtctttatcgccggtaagcgcaaggcccttgggacgaccgatgaagtcgggatgtcttccaccttcttcgcgaacccgttcggcccggttcaagaaccggaacggaccaagccgatcatcgacgaagtcttcaagcgcctctttaaggacggcgtttacgtgggcgaggtttacacccacctagggaccgacaagtctaaagacgccctgcacgaatcggcccaggaactgctagaccagttaatgaactcttaattgtttaacgtatccaatatcagggaccgggagcaactcacagttctcccggccctttttgtttttggagcgcctgatttgttacaataggggaaatgttaaaagggggcagcaaattggaaaaacaagaaccagaagaaacggttgaggagcgcctagttcgcttagttaaccaaaatcaaaaccgggcccgggcttattggctggcaacaccggaactaactaggcagtacttttggggcctgatgacctggtcgaatggtaactaccccggcctgtcgcaaacggagctttgggtcgttaaccaacgggagatggactgggacgactttttagaccaggtggcaaccctgatcaaagaccacccgctaccaatttattacaaccaccggatgactgaggacgacatcagggccgtcaaacaacactttccaaccgccacggttgaccgggcggtgctgaattagggggcgcacgcacgatggaacaggaatcactcttttccgctagtggtcagggtggtgcgacgcccttagctaaccgggtacggcccagggagttggcggagttctttggccaagaccagctggtcggcacgggaaaggtcttaagcgagctgattgaacaagaccggttgccgtccctgatcttgtgggggccaccgggggtggggaaaaccaccctggccgaaatcattgcccaaaagaccaaggccaagttcattactttttcggcggttaattcgtcgatcaaagacatcaagcaggtgatggaagcggcgaccgctaaccaccagtttggggagcggacggtggtctttattgacgaaattcaccgttttaacaaggcccaacaagacgcctttttaccctacgttgagcggggggagatcatcttaatcggggcgaccacggaaaacccgtcctttgaactaaacgccgcccttttatcgcggtgcaaggtctttgtattaagggcgctcgataaaggggccctggttaaaattttgcaccgggccttacaccacccgaatggctttgccgacttggagattacggttgaagacggggtgttagaagcgattgtcaactttgccaacggtgacgcccggatggcccttaacaccttggaaatggcggtgctaaatggtcaacgcaacggtcaccaggttaaattaactaacgccgacctgacccaattaaccagcacccgttcgttacgctacgaccgggccggtgacgagcactacgacttgatctcggcgttgcataagtcaatacgcaacagcgacgttgacgccgccgtttactggtgctcacggatgctggccgggggcgaggagccgctttacattgcccgccgcttggttcgctttgccgccgaagacgttggcctcgccgacaccaacgccctccaagtggccaccaacacctttcaggcctgccagttcttggggatgccggagtgtgacgtccacctgaccgagtgcgtgatctacctggctgccgcacctaagtccaacgccgtgtacgcggcccgcaaccgggcgaaaaagattatcaagcagaccgggaatttgccggtaccgcttcaaatcagaaacgccccaaccaagctgatgaaggagcttgattacggcaagggctaccagtacgcccacgacagtagcgaccgcctgacgacgatgcagacgatgccagacgaaataagcggggcgaagctctatcgcccaaccgatcagggcaacgaggcctgggtcaaacaacgtctagccgccatcgcagcctggcaccgccaacacgacaaccccagggaggggagcaaatgattggaaccgacttaaataccttagcgatcctggtagggaccgggatcggttgcctcttacacggtggtatcaagccacgctaccaagaggccctttacctcgccattggtttagcggcgctggggatcggtttagaaaacgtggtcaataacatgcaaaagagccactacccggtcctttttatcgtcagcattgcctgcggggcggtcctgggcacttgggggaaccttgatgagcgctttaatcacctcgtcaaccgccacagccaaagccagctggggcgcgggctgtccaccgggatcttgctttattgcatcggcgccctgtcgatcgtcggcccggtaatggccgccgtcaagcacgacccaacgatgctctttaccaacgccacccttgacttaatcagttcggtgatcttgggggccagctttggggtcgggatgatgctagcggcgccggtccttttttgttggcaaggggggatctacctggtggccaagtacctgtcgacgagcttttttagtgctagcttcattaccgagatttcaatcgtcggtggccttttgattgccgcttcggggatttctctgcttaagctgcgggagatcaaaacggttaatctcttaccggcgctcctgatacccgtcctcttcttcttgctcaagagttgggtttgagatttaacagaaatgaggtcggtgggaaataacctccgcggcagatcggacgactaagttaggacgcaccgttcttcggcctgtaaagacactagacctgcggttattggccatctttcccgtctaacatccgtgaatacagtaaagaggtagggagaaaaccgtgttttcgccctacctcttttggtaacgggtgattacgatcaaaagggtgaagaatgtctaatacctagcaactatttacgatgatttgttggctgaggggaagtttaaaggttagtgttttcggggattataactatcactagacaagtagcggcaagggtttgagtgatcgtgaaattcagagcaagagaaagccctttcgcaaagctaacttttactaaaatgaacaagtttggtgacaaatgagttattttcatctatttaatataaaataatcgcctctcaatgataaaaagtgcaataaattgtttacaataaaattaagattgttacgaaattcttgggttactttgttaaaaatatgttaaactatctatgaaggcgctttgttattagtcattatgaaagaagggtgtaccttatggatacgactaagcaaaacacaaaccggtggatggttgtcctcggaactgtgtttattcagctttctgccggttccttttacgcatgggccatttttaacaacgggtttatgctcaaaaccggtggggttgttaaaatggtcaacggcgcaaagaagatcgttggtggtcttccggcagcgtccgttagtttcacgtttactttagggatgctttgcttgtccctagcaacgttagcagggatcccgcttgctaaaaaatacgggattaagattgtcaacacgattgcagcaattatttatggtctttccattcttggtttgacgatgatcggtaagggatcatcaatctggaccctgtggctcttcgggggggttctcctcggggcgatgaacggggtgctttacttaacctctttgaccaacgccattaagtggttcccagaaaagaaggggttaatctccgggatctgtgtcgcatgttacggccttggttcctttgtcttcaagtacattgccatgtgggttgccggtggtaacggtgtgatcaacgcctccaacattggtcgcgttctcctctggtgggggattttggccttagttctggccgtggttggttccttactgttaaaggacgccccagaagtcgttgctgcaccaagcgctgcggaagctaaatccgaaaacgttaacttctcaacttccgaaatgctacacacgccacaagcttacatgatcttcttctgcttgatgacggcatgtatgttcatgggactcttgggggcggccgttacgaacatggccgctgcttggacccaatcaccaaaggacgtttcgatctgggccggttctagcgccgccgccttcttcgtggccgtggtggcaattgccaacacgattggtcggttcgtaatggggtggctgtctgacattactggtcggaagccagtcttctttatcaccttcatcattcaactcctgacgctcttggccctcttaatgaccaagccgggggacatgagcatggggatgatttacacggttgttatggcgatggccttctgtttcggtgggaacatcaccgtcttcccaaccttcgtttctgactacttcggtcttcgcgatacttcccgtaactactcggtaatctaccaagggttcgggattggggccatcctggttggtttcctgatggcatcaggtaacccactaaacccaggtaaggtcacccttgctaacggggcggtcttaacgcaaaacttcccattactgtacaaggttctgttggtaatggttatcatctccttggttatctttgcggtaatcaagaagccagttaagaaggcctagcctaaccaaattaattgcttagaaaagcgcctttctgaagcgaagagggggttacccctcatataaatgtggtgcgcgccacaaaaaagcccgtccgggaattccgggcgggcttttttgatccctttattccgttagggcttggcgccaatggtcaagcagggcggttaagtgggggctggtgatctgattggcgccggtaatctcttctaagtggtcgagtagttgggcagccagccggatcgacccggttaaccggagtgactcgagggtttggtcaattcgctccagttgatcgacgccggcaatcgtgtgggccagggcgctcacgaattgctgaatcgttgcaagaggaaccggtcctcaaggggaccacaccgctagagaaagagctcctagccgggtttgccgaccgtcaggcggtccgcttacgttggcgaaacgtgaaacgagcgttgatcgaccgccaagggaggggcgaagacgatgaacacggctaagcggagtgaccttacccagccccaatggaccatcatggttgtagtgttaatgaccgggtccttttgcaccgttttgaatcagaacttgctggcgaccgcctacccaaccttgatgcgctacttcgccgtcaacacctcgacggttcaatggctgacgaccggctttttgatggttaacggggtgatgatcccggtcagcgcttatttaagaaaatcacacccgacaaatctaaacatttgtgcagtgtctcaaaccgggttgaaaaaatttagctaaccaaacaatccccaccagagccagcaagttgctagctctggtggggactgttgctttgtaggagaaattactaacttgtttggtccaagccaaacatttcttctcgaagggcggcgtaaattggccgcccaccgagtaagtcgttgacggtataggaaatgaaggtcacgatcagcatcggtaagatttgctccatggtaccaaccatttcggttaataaacagatggcggtgaagggggccttttcaatcgccccaaagtaggcggccatcccgatcacgaccaggttgatgtagttgccggcggccagcaagtggaggtgcattaaaagggtggccaacagggcgccgagaatggcgccgatcaccaggattggcatgaagattccccccggcaccggggccccgtaggagagcttggagccaacaaagcggacgacaaagtatatactgaggaggtcaaagagactggcgaaggcggccgagtgagatggcagggcgatcaggtggtcaatcagcatgtggctaccacccaataagttgacgtccaacaggccaaccgggatcactaataacagcggcaggagtggttggaccttgctgggtaggttagtgcagtggcggtaccagacccggctgttcaacaggcagtactggtagcaccaggccaacaccccgaggaccaggccaaagaggatcagccaggggtaggcgacgggggggaggttgaaattaactggtagccataagcaggggcgggtgccgtaaacgagcacggtcatcaagtcggcactgatggcggcagctagggcggtcaaccactcgcgaatctggaagcggaaggtgatctcttacagtaaaaacatcgtcccggctaagggggcggaaaaggcggctgccaacttggcggcgaccccgcacgataagaggagcttgttttcttccggtcggcgtgaaaaaggcgttcacccattccctggccgatcgcggcccccatctggattcagggaccttcgcgacctaagaacaggcccgggcagattgccaggaggccaccgacgaactttttccacaggaccggccaccacttcatccggtgctggtcctttaagatcgcttcgatttgcgggaccccggaaccgagcaggtcagtctggtccttgccaattaccaagcttaagagtccccagatgatcacggtggcgatcagataggggattaaccaaagtggttggctgcgtaagagggggtaaacgaagcgggcaaagagcatcgcctggtcaatcagccagcgaaagagtgcaaccaccaagccggtcgctaacccgattgaaattcccttacagacgtcggttaaaaaattcgacgagagcggtcggtgtaaaacgtctttagcctggagttcctttcgccttcattatacgctactgaaggggcgcgggggttggtggaatgaaatctgcatgctaactcgccaagtggtgcgagtaaaacgctaccaaattttggttgacaaagttaaaccacccttataaaatgattaaaaataaataataatgcgttaatggaatgagtaagctaaccaaaccccaactagagaagtgggactggtggaaaccacgggggcggcggtagacgaaaatggttccggagcagttggtggggtgaacgctggtgagccccgcccggttagcggtcgttaccccgcttgagtctccccgctgggggtacttattgaggagtggggggtgacccctgcttaaatgagggtggtatcacgtttgacgtcccgaagagaggaaactctgttcggggcgttttttaattagttttttaattaaaggaggaagaaccatgaccaaacaacacttagcagattatacgattgccgttttaggggccggggccgtgggccggtcggtggccgccgattgtaagttggccggcaaccaggtccgtttgtttgacctaccggagtttgccggtgaatcacttaaggacctcgacaagaccgggatcgaaattcaaggctttgagttgggcaagtacaactttaagcgcaatgggatcgccaagttcgacctggtgtctgacgacctggccgaagtggttgccggcgtccaaatcattttagtcgcggtgccgtcggttggtcaccaaaccttctttgaacggctggtgccgctcttagaagacggccagatcatccacattatccccgataacttcggtagcctgcgcttacgcaaggtcctgcgcgaaaccaggccggacgtcgacgtgattgtcgggggctggtcgagtgccccgtacggtacccggattgttaaggaagcgggaattgacaccaagcgggtcttcttgcgttaccgggcggtttccctgcggggggcgtctttaccgtccaccgatcaggaggcctttttaaagagtaccgaacacattggctgctttgactcggtaacctttggcgacggcccggtcggcggcaaaacggtcttagacgttggctttagcaacgtcaacccaaccctccactgcccgggaacgattctgggggccgcagtgatggaaaactacggccgcgtctttggtggcaacgacaagagcgacttttcaatttattcccacgtttacaccgagtcggtttcggcggtccagtactccttttaccaagaagaaatcgagctggccgaaaagatcggtgtcgacatcgctaggtaccccaaggaaaccttctattcacgctctaacatcttagggcccgagtacatgggcgacggggccagcgctccgtttgacgagcagttcccgatggcctttgggaccgggccgtttagcatccaggaccgttacgtgaccgaagacatcccggttggttgccacatctaccacgagttggggcaaaagttcggcgtcaagaccccggtgatcgacagcatcattaccttagggtcagcgatggtcgggattgattttgatcaaactggggtcacccttaaagaactcgggatcggccacttagaccgggccgaactgttggactacctggaaaacggcaactataaggaggaagcttaatgaagaagacgggcgactacttggggagtccagcggacctggacggagtggtgtcagtcactccccaaccagtggccggagcggcgatcggaatcatcgccgtgaacctggtctaccccaagctaccggggaacgtggccaacgctagcacctttgcctttccggtcgactacgaggtaattgacctggcgatcgagcagctctttgaagccgatccgggggcggtcgaccaaattgttcaagcggcgaagcggctggaggcccgcggggtgcgggcgatcgtcggggcctgtggctactttgctaactttcaaacccaggtccaagcagccgtgcgggtgccggtccttttgtcgagcctggcccaactacccctgattaagacgagcttacgggccgaccaacggattgccgtattggtggccgatattcagggggcgacccctgaattgctggccaacgttaacgccacgcctgacaaggtgaccttcgttgacatcggcagcctgccggaatttcacgccatccgttacggggaaacaaccctcgataacggcgccttaaaacgggccctggtccaaaaggcggtagcggccgtcaaacaggacccgagcatcggcgccctcctcttggaatgtagcgatttacccccgtacgcggccgccattcaagcgggggtcggcttgccggtctttgacttcatcaccttaatcaactggttgcaccagtcgctgtgccagcggccatactacggattcatctaaataaaaaagaggctaagggaaagtggtgctttcccttagcctctttttattaaaagttaatggtgccagaaaccaaaccgtatatcccggccagcgccatcagggtaatggcaagccaggttattttttctacgatggtgaaggggcgttgctgttcttttttcccctggtaaaagaaccaaaagccggtttcccagacgatcgcgctcaacaagaggtactgtaagccggccccgtagagcatgaagaccgtaaaggccagggctaataaagcggcgatcccggaccgcacccgttcggcacgggaacgctgagcaaacccggtgcccgccaagacgctcttgacggcgtaaagggaaacgaacaggtagggaacgatcgaaagcgaggtggcaaacttcaagaggaccaggtaaccggcgttggaacaaccggccacgatcattaacgcctgggttaaccccgaggtgaccagcagggcgttttgcggggcttcgtgattatttaggcggtttaaccacttggttgccgacccggagcgcccggtcaaacggatttcttcggaacacagggtgatccatgcgagcagggccccagtgaccgaaacgattaggcaggcgttaatcagggtgctcccccagttgccgaccatctgagccattaagccggccatcgagggggtgtgaagttggctgatctggctgggcgccagtaagccgagcgataaaacgctggtcccgaccaagaggaggataatggctaaggagccgagggtggttgccttggccacgtctgacaggcgtttggcccgggtggcgtaaattgtggccgattccaggccaatcagcgtccacatcgccgataagaggacggatttggactgggcaaaaattgagacctggtgccagtggtggctaccggcgtcgaaaaccctggtggaggcaaaggacgcccagaaggtcggggcgtggaagttgagtaaggctaagatgataaaggcagccagggggatgatcttgatcacggtggtgacgttgttaaccactgtactgtccttaaccccctgggcaaccaagaaggtgattagccacaagaggacggaggcggcgaccaccgccggccaggtggtcccgtcaccaaagaagcggaagagggtaaagccaccgaaggccgaaaagataacggtcaggtacgaggcgttaccgactgcgtcgccgattccgtggccgtaattggcaatgaagccgccgaggtgaccaaagagggccttggaccaaccgtagatcccgtcgtcgatttccggttgctggagggtgaggttgcggtagacgctggtcaaggcaaacattcccaccgccacgattgcccacccgattaagatgccgagcgggttagcgttggccgtcatggtggccggcagggcaaagatccccgagccgatcgttccgccaataatcagggcgacgagcccccctaaaccaaccttatttttgatttccttactcatgtttgtcttcacctttttcatcaattctctgttaatttgcgtggatatgcacacaaattattaattatacaagaacccggtcaaaaggtaaataaaatggtggaaaaaacataagcaaacggggctaaggcaagttgcctcagccccgtttttaggagtgtaaattaatggttgttacctaatctaggtcgacgggcaccacccagccaaacttgtcttcgacgtcgccgttttggacgccggttaagtagttatacagcttggtcgtcaccggaccggtttcggtttcggaataaaagacctgctttttccccttataggttagggaacccaccggggagatgacggcggccgtccccattgcgccggcttcggccaggtcgtctaagtggtcgacttccagttgcttttcgaccgggttaagccccagttctgcagccacttgtagcaacgagcgcttggtgaccgatggcaggattgactccgatttaggcgttacgaactggccgtccttagtgaccccaaagaagttagcaccggagaattcgtcaacgtacttgtgctcgcgcgggtctaggaagaggcagtcggcaaagccggccttcttggcttccatttccggcaggagggagccggcgtagttaccggccgtcttagcttgcccggtcccggcgtaagcggcccggtcgtacttggaaaccgtgaatggtaccgggtttagtcccttgacgtaggcgccaaccggggtggcgtaaacgcggaaggtataggtgttggacggtaccacaccgaccaccggctgggtgccgaccatgaaggggcgcaggtaaagggtgccgccggaaccgtacggcgggacaaattcctggttggccttgacgacggccttgaccgcttctaagaacttctcttccgggtagggttccatcatcatccgcttggccgagttaaccatccgcttggcgttttggtcggggcggaaaaggttgacctggccgtccttggtccggtaagccttgaggccctcaaagacctcctggccgtagtggaggacctcggcggcttcgttcagggttaaagttgattcggtcgtcaggtggccaccttgccactggccgtccttgaattcctccgtccagctgtaggggaggtcgtggtattcaaagccaaggttgttccagtctaagtcttctacgcgggtctttgtcatggtaattcctccttaaagtgggtgacgcctacgccggacgccgtatgaattatgcagtgtgcattgcaatggcaatatgtgtaattggttggcgtaaatatgtgtagtgatgggtgccaatgttttgaatatgaatctctgaaatgtctgcttccacaactcatcacctttccttcgttagtttggttgaacaaaaaaacgccctactagcattgctaataggacgacttgcaccgtggtaccacctaagttcgcttgaaaaatcaagcctcaaacgtacgatcgctcatacgctgcacgataacgggtgccaccttgctcccttaccaatcggggagcccgctcaagaatgatcttcagcagtcaggcgccttcccgtttcaccgttaccgggcttctcttagcgcaccagtcatgcttactgtttctctcatcgcgttgtttcgttcaactgattggtacccatcttaaagccgggctctcacgatgtcaacacttttttctcatcttttgttaatttatttttaacccggaatgtcaactcaagcgcaacaccatggagccagaccgtgagctagcttgctagcgcggcctcaataagctcggcggcgttagcgtagccgagtgtcctgcgatgtttttgattcagcgcatcttgaacctttgcgatatcatcttcagagaagccatgtagtgataggcctttagggatgtactctcggatcaggccattctggttttcattactgccacgttcccaaggcgagtacgggtgcgcaaagtagatctgagctccttgaacctggtccaacagtttgaactcagagccgttatcgaaagtgatggtcttaaagtagccaggatgctggtcaatggtggcttgaagctcttttaagcaggtgtctgcgtggtagttgggaatcttgacgatgatctcatagcggactcgccgttcggtcagggtcatcagtgctggttcactggcttgacgcttgcctttaaccaggtcaccttcccaatcaccaaagcgttcacggttattaatagtgtctggtcgttcatcaatcgaagtaccagccagacgcttatttttacgcgagtggttgtgacgattggactttacatggcgccgcagcttggctggcaggtcgatattcttaatgtctaagcggccttgatcaatataccgataaacggtcggcgttgaagggcacggctggtcaggatgagtctgcttaaaggcgtgcacgaaaccatcaacactatcaatccgtggtcgccgtttaagcgctgttttaagcatcttaaagaacaaccagcagaccttttctagtccgccaaaacggcagttctgacgcgctttatcatgaataagctggctcgtgtccgcaaagtatttggtgaaaaagagatagtcagaattacgttgtcgaatggtgccacgcttaatttcacgcgagatcgtgctgcgactgcgattggtcaggcgcgcaatatcagcctgagattttccagcattcaagtacgcttcaatttcacctctttcttccggggtaagttgttgataatgtttggtagtgctatgcttggattgggtcatggagatgtcctttctttagagtttcagcactttaagtttaggtctccatggcctatttgtataatttgaacttgttgcacttagattttaaatccgggaatttatttttaatctagctgggtgatcagcttccgtaaggggttctggttatttgggcccgttaattagacattatttactataacttaacgtcataaataacaaccaccaaaaaacgagccctagttacagggttcgttggtgaagctaatcaaagtatgacggagcaatctttcggccctggtggtaatatactgacggtcgtgttcgttaatctcgcggatgaccttggccggcgagccatacgcgaccacgttaaccggtaggtccttggtcaccaccgagccagctccaacgacggtgttatcaccaatcgtgacgcccggtaggacaattgaaccggcgccgatccaacagttggttccgatgtggatcggcaggttgtattgcatttccttggcccgcagttctggagccaccgggtgggttccggtggctaaaatgacgttggggccaaacatggtccggtcgccaacgtaaacggcggtgtcgtcgaccatcgtcaggttgtaattagcgtaaatgtagtcgccaaagtgggcaaacttagccccgaatttggcgtgcaggggtggctcgatgtaggtgtgttcaccaatttcggcaaacatcttttgcaagagctcctggcgctttttcccttcggacgggcgggtttggttgaagtcgtactggagttcttgagcggccaattgggccttagcgatatccggatcgcttggcaagtagaggtccccactgtgttgaagatcttgggctttcataacaaagtcctttcggttaattttgttcattatactggatggtaacgaaactatgcaagcgccttcacgggttggtataatgagcaaaagaaattaaatttggagggtgaattatgagtgaagaagtcaagattgatgccaaacgggtgcaagccattaccaacatgggccaagcttacgatgacgtcgatcccctggtggaagccgcccgtaaccacgcaattaaagagtgccgccgttacaatttcttggtcaactcccaaaacaagtacgattattcgatcctgaagggcctcttcaacaagatgggggaggaaaattatatcgaacccaacttaatgtgcgaattaggcctgaacatttcgctggggagcaatatttacattaaccacaacatggtgattttagattgcaacgaggtcacgatcggagaccacgtttacatcggccccaaggtcgggctgtactgtgccaaccacgccgaagacccggtggaacgggcgaaccaccaagtgtacgccaagcctatccacataagcgatagcgtcttgcccggggtgacgatcggcgagaactcgattatcggtcgtcaccaaggacatccccgctaacgtaattgcggccggcaacccctgccgggtcatccgcgggattcagaaaaaaggctaacaccttaaacgaactcagtttgaatgcctagctaatcgaataaagcctctctccgaacttcatcggggaggggctttttagtgcggttaaagatcttgatcatccggcaagtttttcaaatagcgttggcggaattcttggttgccaccccagaaaggtttaacacgcctggtcgagagcttcttgatactttcgagtcggtcgcgttctgcttgccagacctgctcttgctcaacggtaccgggggttaggctaaccatctcgtcaaggagccggtcttgttgcgtagcatcatctgttaaataataacgcattagtaacccaataaacttagtattgctctctggctggagcggtaaaactaagaagtcctgtgtttcaaacgctcccatcgcctcgttagccgcaattaaggcggtcctcttgttaccatcctggaatggttgcattttagctaaatcagcgaaaactcgccaaccatctttggtggtgtattcagaggtgtcgaaacggtcgatcatttcttggagaatcccctcagtaacaatttcgggcagggtgtaggagtcgcctattaggagagtaggaacgttccgcaatcatgtggacattgtcctcttcgttatacatgtaattccgcaaatggccaggaagcgtgggggcttcgatgggactattggtgaactgttgattgattgcaatgattccttggacggtaaaaccagtgctgataattgcattaacgccgttttggatatccttaaataaatcttggcctgtcctttaaatacgaaagatccttcgttgataatgcagatttagtactagttaaggtgctaccgtaattatttagcgaaccagttgacgcaatgaaaaaggaaaatttattgatatcaatcttcatggggcacgctcccaaaaaaatagtaatacgaagccgttgctttaaattatatcatcaacggtcgtcgcagttagttatctgcctggttaaagtgcttcaccctttttattaaagaggggaaggggctttaagtaggtgatgtctgtccggttgacggcgtctccttcggcaaggatggcagcctgagtaataacggttgccccgcactcctttaacagctgagcgccggcttttaaagaaccaccggttgaaatcacgtcatcgactaggattacccgttgcccctttaaagcatgcgcatccgccccgtctaagaccaattgctgcggttcactagtggtgatggcttgaacggtggtcacgtaagggttgtgcatgtaagccttaacgcccttgcggatcacgaagtagcggggatgcttggttaaaagggctagttcatgggccagggggattcccttgctctccattgtcacgagcgcgtcaaaatcggtgggcaagaggggggctaacaagcgggcagcttcgtgggtaaattcggcgtcacccaggatgacaaaggaggcaattttgagctcagaattgaggtcaattaagggtaattggcgctgcaatttgccaatttggagggggtaatttaacatttttctcacctttttgataatcttaactttcaaccaacatcttactattattgttcgttaattgatagggagaagggggtgggagaaggctatgaattataataaggttcgtcccgtcacgattaactagtcttaataaaaacttaatgaaagcgattgaaaagagtcaaaaaagagagaaatgttttaaaataaaccaaaaatacggtaaattaatattaatcgatttcgtgattttcccgtttttcctggatgaaaaactggttaaccatcagcgaggaagttaccggaatccggataatgacttcaaaattaatcataattttcgaaggaggggatgctcttgaagtcagcagactaccgcaacgccccaatggagaaaatgagttggaatgttttcattggtgttgtcttaggacaaattgttagtagctataccttagggatcgtcggggtcgccctcgaccgggtgcccagctccatgaccctatccagtacttggttagggctcttgggggccgggtcgttaatcgggctgtttggtagcctcttggtggggcgccttgccgaccgctatgggcgccggaagtttttcatggccgatatgctcgccctaacgcttctatcagtgctacaactattcaccactaacttagccgccctgttagtgattcgaatcgcccttgggatggcaattgccgttgaatacacggtcggcaccgccctattgatggagtgggtgcccgccaaacgttactttcgttaccaaacctacctgttagcatactgggcgattggttactttgccgcctacctagtcgggacctttaccaccgggtttggcgaccggacttggcaagtgatcttagcctcgtcggcaatcgtcagcactttggccgggctacagcgcctcgtggttcgtcaacccgagtcaccacgctggttggcctctaaggggcggattatcgaagcaattaacctggtacaccgttacgtcggcgaagattacacggtccagccggccccgcaagtcgaagtaaaaaagggcgcctggcggatgctgtttagcaaaaaataccggcgccggaccttggtcggcgggctcttttacgcttgccagaccttcccattctttgggatcagcatcttcttgcccatcctgatggaaaatatgaacgtgactaaccccttggtcacccagttgctttactacgccttgatgatcgccggggtcctcgtggggatcgtcttgagtaaccgcttgccgcgccgttacttcttgattgggaccttcttagcctcggcggccttcctgctggtgctcagtatttggcaccaggccccgttagccttaacgctaatcttgtttagcctcttttccttgacgatttcggccgccttggtaatggactacgcttacccaaatgaactctttgacgccagcatccggacctccggggttggaatgtgcattgccattagtcggattggggccgtggccgggaccttcatgttgccaatcatcagcaacgcctggggcagccaagcgatcttcatcatctgcgggacggtcttgttaatcggggggattatctgttaccaatgggcaccagaaacttccttgcgctttgccaagcacaaccgcagcaccattaacgaaccaagcggctcccgggtaactagtagtcgctactcggacagcacgattgattaaagcacggttgataccggttacaaaattagttatacttaacccatcaaattaaaaccactttttccgacaccggttgggaaaagctaggcacctatgattagccgtaggtatgacggattccgtctacggattccgtctaaggctgatcatgggtgccttttttcataaaaggaggatttaacatgacccaagtaacgatgttaagcgcaagccagattagccacctcttggacatgccagccgtgattgacgccgtggcggatgcttataaggaaaaggtgaatcatcccgcaacgctttggccaatggtttatgagcaactcggaggtgaagcggacatggacatccgttccggggtgttagcttctaagcacgttttcggcaacaaactcctcgcttggttcggcgagaatgccaagcggggtctgccagaattaaacggcctagtcaacctttacaacagtgataccggggagccagccgccgttttaaacgccaccgccttgactggttttcggaccgggacggcgggggccgtcgctagccgcctcttggctaacccggatgccacgaccttgttagtggttggcacggggagccaagccccctaccaaatcatggcgcagctgtgcgttttacccaaggtgacgcaagtgctcctggctaatccacgcgacgcaaagaaggcccaggcggccgcagcccaaatgccaaggaggagtaccatgaagattaaagactttggcgtggaacaatggatgaacgaatacgaaacgaaggccaagtataacctgggcgaaacctgcgtttcctcgttaagcatccgtgaattgtgtgaactggtgggtgtggacgttaatgactttgctaagcagctggttgatcggcgcctaacttatggcgccattgaaggggcggtcgagctaaaggaagcaattacccggctctaccagtatttgacgccggacgagatcgtgaccgaacacggggcgattggggcgaacaacttggtcttaaacgccctggtggaacccggggatgaggtaatcgccgtgacgccgacttaccagcaactccagtccatccccgaagcaatcggggcgacggttaagttactaccgttaaagagggaaaacggctacctcccggatgctgaacaattgcgggggttagtgagtgacaagactaaactaatcgtcttgaataacccggataaccccaccggcgccctgatgagccaagcagggctccagacgattgtggacatcgccaagagcgttgacgcttatgtattgtgtgatgaagtctaccggcacctgacccaagaagacgggtactcaccgtcaattatcgacctctacgataaggggatttcgacctcatcgttttccaaggtcttttccctcgccgggattcgcttaggttggttagcgacccacgaccaagcggtgatgaaggcctgcctgtcctaccgcgactacgaaacgatttcttgtggccagttagacgaaatggtcggtaccctagccctgaaaaaccaagcagtgctcctggagcggaaccgggggattgtccgggagaacttaaaggtcttagaggaatgggttcaccaacaaccacacatcacctggttaaagcctaaggcggggaccacggcgcttttgtactatgactttgacctaccaagtaccatcttttgtgaccgcctaatgaaagagtacgaaaccctactggtaccggggagctgctttgacattgagaattcgctgcggatcggctacacctttgaaaccacccacctgcgcgatgggatgaatcaattggggaagttccttgctaaattagaacaggaagcaaggtaaggatgcacccctttaattatgaaaaccgcctagtcactccgttgtaagtgcctaggcggtttaccaaaaattgtaattaattacgttgacaaagtaaaacaagagagtactctaataacataggctacttaatgctagcttacacggcgacaactccacgaataacacaagcgattgtggacaaagggaagtggtcaaaatgtatgaagcattgttgtatgtagcaaccttgtttagcctgatgagcggcggcgttcttgcggtggtatcaacgattgataagttgtacgacctaaaagaaaaagcccacaagcgaccgggcgatcacaaggggcaataagtaagtagcttatgatttaaaggctgggtgttgcaccacctagccttttgctacagttactttatcacgaaagggaacgggtggcaaacgatgagatggattattttaattgctttgtttgcattggacgttggtatcgtatggttaatcgttcgcaaggttaagtccattcttgctaagagaaaagggcggcgttcataatgccaagacctaagacgttatctgataagcaacgagaagaccacgctaaaaagagtcgtgatcgttggaatgctgccaaccgtgataagggctatcgctaccaaaagaaatcacgtgctaaaagctttatcaaaaaagacgcatcacttgaagaacttcaggagctccgaagtttgattgatgatcggattacagaaatgagggactagtcattatattggctagtctttttttactacttaaatggtccttgcaaacctggaccgacctcaaaaacaacgttaatgagtcgctggtgagccgtaataatggtcagtcagccgtgaccaaagcctaccggcagatcttaacggagtcgaccaccgctactgtcaccggtttgatgacccacaaggacgccgtccaggcagccatgtaccgggtggttgataaaggactgccgaccacgttgatcgataaggcggggcgcaactggagcattgaaggttacacacggatggtggtcaacacgaccgtcaaccgggcatttaacgaggttcgcctgcaacggatgaaagacttcgacatgcacttagccttgatgtcgtcacatcccaacagccggccagcgtgtgcaccaattcagggccacgtggttaacttagtttcgccgagtgatccggactttgacccacactacgattcaatcttcaatcacggatatggcgaaccgtctggaacacaagggattaactgccggcacattctgttcccgtacgagccaggcgtcagtgagaaccatcaaccacagtatgatcccgatgaagcgatcaaaaacggcaagctggtccaacagcaacgggcacgagaacgggccatcagggacgctaaaaagcgcctgagagttgcggaacaactcggtgatgatcaagactaaaacgctcctacgagcccgccaggcgaaactgcgggacttcatcaaagagaccaacgccggcaagaagaatccgattctggtaagggattattctagggagaagatcgtcacaaagataccgataatcaaggtgaacgaatcgggctgatttcaaagaccgttcaacattacgggtcctttctctagtgtagagaaggtccatgcctatctttccatcctttcattggcatcactcctctcaaatacggagcgtcgccaacgatcttgacctaatcattatagtgtgaatcagggggaagaggtagtatcgtaccaaaacgaatacacccaactggtaggcggggtggaggaaagcgagctcgttgctaaaactggcaacgggctttttaaatggggtagtgttttggcttaaatcaacctgtcattaaaattatagttttaatgacacacattaaaagaaaccctttagtatcaatggatttcgtaattttaatttcgttgtttttttacacaccttggtttaactttgcaacgccccgctcgccttcgctgttggcaacggttggatacttccccgttggttgaagaagtttaaccaggatgccaaccatcaaaaccttggaacgaaccaagactgggcgccggacggttaattagtgccacttttataaatatatgaaaaaaccgtccagtgtttggacggctcggatggcttaatttaaatgcttcttgaggaactccaaaatgagcttgaagacggctggttgcatgaactggacgtccatgtggccggcagtttctaattcatagagatccgcatcaacgcccgcttggttaagggcttcatacaggacctcggagtctttaaccgggacgacctggtcctgttggccgtgcaggattaagaatggcacgctcttttttgaaacgtaggtcaatggattggccttggcatccagttccggggcgtcctctggctcggcccccagtaagttacggtaaacgaagtcaaaggcgtctgtggcgctgccttgtttagcagttaacgggtcaaccacgccgtaccaagggactgccacttgaacgtcactggagacgtctaagtggtcgccgacgtcaaattccgtcatcccgttggtcaaccccaacatggaggccaagtgaccgccggccgattcacccatcacgacaaagcgatcgggatcggcctggaacttcgcggcattagcgcgcatgtaacgaatcgccgccttggcatcctcgagttgacccgggaagttgaccttgttagaatcgcggtactccacgcccacaaccaaataccccgcccgggcaaagtcaactaagtttggcaagtggatgttgtggtcggtatccatccatcccccaccggcaaaccaaaagatcactgggaacttggtgtcatccccggtggcaaaatggcgtattaccgacagccgtaagttgcgggtggcgttgcccagccagccgggtacctgggcatacacaatgtcggaatcgagccaaagcccatcccgttcaacagcaacgttaatcactttcttcaaaagaaaaacacctccaatgctctcatgatagcgcattcgggaggcgttttaaagttatagcttcagttcgtataagttggcttcttgacgaccaacgtcttcgtagtcgatgacgacccgtttggcgagttggtagccgttcttttggtataaggcatccgccggtgggttaccgtcaattacgtctaggtgaatgacgatggcgcccgcctctttagcaacctgcttgagttgtgctaggagaccactagcgacccccttgccacgagcggcgggaccaaccgccagtaagtgtaggatcgcaatttggtcgtccgtggctgggatcttccaggcctcgctcgggtaatctgggtcttcgcccttcgtcaggatcccggcccccagtagcgtaccatcgtcatcaaaggcgccgatgaacaagtcgttgaggctttcttctagcgactgttcacttgggtaaacgccccaggtccaatccggactgtattgatcgaactgttggtggtcacaagcatccttataaaaagcgattacttgcggcaagtctgttttagttaaacggcggtaattaatcatataattcctccttgcgctatggcgtttggtaagggaaccagtggttggcgctgtggtcccctaaccgtgagaagggaaccatttcaatcccctgctcctttaatttgtcttctaagtaatcacggacctcccaaacgtcgctagggtctgggtgctctccatgtttaacaccgcgtccagtcgctcagcgttcatctctaggtcggcgagtacggttgcttctggttggtttaagcgtcggtaattggcctgtagctcctctttagtcgccttaatttcggcccttgttaacatcgcaacgcccccttttcagttatactgatattataacaaaggaggtcggatgaatggtgacgttattaatcggggctggattaatcatcctggggatagtggtgattgcccacgatcgccgcacccttttaagtggcctcttgcccttcttagggttactaacctggctcactgggctgacccccgtttggctggctagtaccctgtttgtcatcgttctcccgctcggcattttaggtgaggtgttgacccacgatggctactggctactgagccgttacggtacgtctgctaagggctacttctttttggtgggtggttttttggtaatggtgttcgccccgctgttcccagttttatggctactatggcgctcagttttgatcgttaaattgatgttggccatctacggctacgtggcggtcctgattgacgcttaccttttggcaacggtgatcaacgccctgccattaacaattaaaccaaccaagatactaattttgggcgccggtctcatcaaagggggcgtgggtccggttttacggcgccgcttgctaggtggcttggcgctttaccaacgcttccccaaggctgaactgattatgtccggtggtcagggggacgacgaacccgaacccgaggcggtcgcgatgcaccggtttgcccgccaaaagggggttcccgagtctgccatccgcttggaaaccaactctaccaatacagcaaccaatttgagcgaggccaagcgcttcattaactcaggtgaccgggtggtcttggtaaccagtgattaccacctcctacgctccctgctctacgctcgccgccagggggtgaattgtcagggtctggccgtccacaccccccacttcacctttacttgcaacgccttcatccgcgagttgggggcctacacgatcattcaccggtacctcatccccttagggttagtgttggtgattatactttgtctaatctaaaaaccgggtgtccagtggaccccgatttttaaattaatcacggtcatcgatgtagtcgtcaaccccgtttggattccccgaccacttgaatttgtcgtaccaaatggcgtgttcttcggtgttgagactgaaaatggtggccatttcagtgtcggttaaggtgaagtcaaagacccgttggttagcaatgattcgttcttcgtgaactgacttgggaataaccacgagcccctgctggagttcccaccgtaaaataacctgggctaccgtcttttgatgggcgtcggcaatcgtttggatagttgggtttgacagcgcagcgcccccacctagtggtgaccaggcttccacttggatgttgtgttggcggcataggtcgcgaacgtcatcctggtggatccgggggttaaattcaatctggttgaccgccggaacgacgctcccgttatccaaaaggtcactgagccgttcaacgttgaagttgcagacaccgatcgccttcgccttgccggcggcgtaaatttcttccatcgcccaccaagttgcgttgtatagcccgttaactggccagtgcatcaaaagtaggtcgacgtaatcggtttgcaaggcgtctaattgcccttcaatcgcgtctaaagttggttggtgaccctggtcaccgttaaagaccttggtggtaatgaagaggtcttctctggacttgccggtcgcctttaagccttcctgaatcccctcgccgacgccggcttcgttgccgtattgcttagccgtatcaattagggtgtagccatctttaattgccatggtaacggcttgcttggcagctcgattggaggtcttccaaacccccatccctagctggggcatcttcagtccgttatttaatgtcactgttggaattgtcataatatcccctcctgttaaagtacctttattatacgccaattgaaagcggaaacaaaaaagaggccataaatgacctcccgtgagtttttgacttaattcaagcgcacggcccggtttaaggcgggaatcagtactaaggcaacgacagcgcccaccaccccttgcaagatgttagtcccgatcccgagtaccccggcggtgatcgtgtagagaactgtgtcggctacgaagtaaccaatcaccattacaaccaccccaacgcttagggcgaggtagcggttatgggttcgctggtaaaggtagccgataacccagccttccagcccgtgggcgattaaagaaaagggcgcgtaagcaacgtaaccagagatcaggtctagaatcatcccgctcaagccaccgaccaccccaccggctagcggcccaatcatcagggcggcaatcataatccctaggtcacataggttaacgttgccgtgggtccatggaatcggaattaaaaagaagcgtcccatgacgacggctaccgccaccaagagggccgttaaaacttgcttttgtgtgcgttgatgattcatcccaatcaatcccttctatgcttcaaaactggtcaagtaggccagtaagtgactaagttgcaagccgtagcggcgttggccctcgtcaaacggggccgtttgaacgatcgctaggcgcaggccttcgtgggcaacttgaatcgcccgctcaaacgggacgtccttgaccagttggctggctaaaatggcgctaaacaggtcgccggtgccgtaaaagtggcctgggatccggggcgccatcaaccagttaaactgatcgtccttttccgcctggtaggtagttgatgaagtcccctgccctaagataccggttacgatcacccgagcggagatcccctcttggcgcagctgctccaccatggtatctaatagctcctgagtgtactcactggtggggtcataaccggctaagaggcataactcggtccagtttggtgtgatgacggtcgccttttggcaaagctggcgcaccgccactacgtaatcttcatccagaccggggtaaaggctcccccggtctcccatgaccgggtcaataaccgtgaccggcaaggaaaagtggtcaatgatgaccgaaagcttatcaattaaggcggtttgaccaacgtagccaatcaggatgccggcaaactcctcccccatgtcaagccactgggcaagggcattttccagccattcctcagttgacagggctactggggtgccaaaaccttccgactgggttgaaagaagggcggtgggcaacattgctggtcttacggattgggcttgtaccacaccgagggcattggctagagaaatttgccccaaggcggtcaggtcttcagcaatcatcagtgttttcattgtactcgctccctttttgaacacatctcgtttgtacgttgattatagcacgcctcgatcattaaaaaagtctaatgcaaaaaagaaagggcttttcgggaaataaaaaggccccgttaaccactttttgatggtgttggggctccttttggtcgcttataggtggctgacgaggtaatttccgaacgaactggtcgagaggacgttggcagccgttgaggttgctaggtcggccgtcacgtgttgcgatgcgatggcctgggcgatcccctggcgaatcaaatcaccaactgcttcccacccgaggtaatcaaacatcatcgccccggacagaagcagggaggtcggattcatcttgttttgaccaacgaattggggtgccgtcccgtgggtggcttcaaacaacgcttggccggtttggtagttaatattagcacccggcgcaattcctatcccccccacttgggcggctaaggcgtcggaaaggtagtcaccgtttaggttcaacgtggcaatgacggcaaagttttccgggtggaggaggctttgttgcaagaagttatcgcaaatgacgtcgttgacgatcagcttcttttgggcacgggcgccttgaagggcctggtcagcctgatgttgactagttttagcaagggcctggtattgtgccattgtaaaaagtcggtcaccgtactcttctgctacttgatagccccagtttttaaaggccccctcggtttgcttcatgatgttacccttgtggaccagggtcagggtgagttcattatttctcaaggcgtattcaatagcggcccggactaagcgggtagtcccctcctttgaaaccggcttgatgctgtaggcagacgtcgccgggaagcgaaccttggccagttgccgctgttcttttagcagtgccgttagtcccttggccgcctctgtccccacccccatctcgattcctgcgtaaatgtcttcggtgttttcgcgaaacagggtcatcttaacccgttcaggataacggactggcgagggggagccgggataatagcgaaccgggcgaacgcaagcgtataaatcaagttcctgacgtagggtgacgttaattgaacggtgacctccgcctactggggtggtcagtggccccttgatggcgaccaggtatcgtttgagggcggcaagggtcgcgtccggtagccagttcccggtttgttcaaaggcggcttgacccgctaagaccggctgccaagtaattcgtcgcgttctcccatagacctttttaacggcagcgtcaaagaccggttgggctgctgcccagatttccggcccgataccatcccccttgataaagggaatggtggggtaatctggaacccggagttgaccgttttcaagtttaattatttctcccatgttttcctcctaactaagtgctaaaacaaaggcggtcaaggtaatgaaggatcggtaacatgatcacgttgattgtcagggtacagatcccgatcgtgatagcactgtcattagcgccgaaaattaacggtaatacggccgagccaacgaagggaaccgaggggtcggcaatcgacattacgcgtaggatggccacgggggcgtcatttgcttaataaagcaagcttacctgacgggggcgagcagaatacgaacgaaggccgttgtaaatgaccatgctataatgaagggaacatcaattcgtaaggaagttaagcatggaaacgcaacgataccttaatttaatcgaccgggagctaaagcaactgccagattttgtcagcgagtaccagctgggcacccgccattccctcaccacttcgtaccagtacctaaccgaactgcgccggtttttcacctggctacgcaaaaccggcttaagcaaggccacggataacgcccacgtgacgacggcggaactggaaaagctacgccgcaacgacatcatgcagtttattgacgacttggcccacaccaaaaatgcgcagcaacgacttaattcgcccaccacgattaaccggtcaatcaacgccctgcgctcgctgttcaaatatctgaccgtaaccgccgacatcaatgggggccagccctactttgagcgtaacgtgatgctaaagatcgactccttaaatgacaccaagactctgaattaccgcgcccacgtcttggaggctaagatgtacaccggccagctcaagtacgattttttaacctttttagaccaggagtacgaacaaaagtgtgatccgcgcgcccggaccgcctttgaaaagaataaggaaagagacatcgccttggtagccctgatcttgggcaccgggatccgggtctcggaaacggcgggtgttgacgtcaacgaccttgatttaaaggggcagaccctggaagtgacccggaaaggtggccaacgggatgcggtcccaattgccccctggacgatgccctacattcaggcttacgccacgattcgccgtcagcgctaccaaccggagaaaacggagcgggccttctttttaacccactaccacgggcagaccaagcggatctcggtcaacgggattgaacggttagtcagcaagtactcacgggcctttggtcatcccttgaccccgcacaagcttcgccataccctcgcctcggagctgtacgacgtgactaaagaccaggttttagttgcccaacagcttggccaaaagggcacctcggcaaccgacctttacacccacgtcgatcaaaccaagcaacgtcaagcactggatgaagtcggcagcgacgcaccaagtaaagagggtgactaggatgtgcacggctgtttccttttggtcaacggagcaccaccgctactttgggcggacgatggactttccggtcaaaaacaccccttggaacctcacttatttgccgaaggggtacctttggcgtcccctcgccccccaagccgcctacccctctaagtacgccattttaggcgggatgcgccgagtggatgattattacttaattggcgacggttttaaccaggcgggactagcggtcgccgagctttactttcccggccaggttgattacgccgcccgggcccaaccggggaaaattaacctctcaccccaggacgtgattggttacctactgggcaactgcgctaacattagtgaggtggcggccctgctaccccggttagcaattactaaccggcagtggtatgaccacgatatcatccaccccttccactggttcatccaggatgccagcgggacctacctattggaaccaactagccccaccctgtccttgcagcgagttgagttaggggtcttgactaattcacccacctacgccaatcacctgcggcggctccgttcctttctgggcttgagtgccgacgccccgcttaaaacggtggaggaagcgttaaaggattaccaaggtgatctgccgcaagctcgctccccgcgttcacggttcattgctacgagcatccggttagcgcaccaacttccggttgatgatcaccaagccgttgcccagtcaatgaaggttttgggggcggtgaagatggcgcacctgccgggtcacgatgacttcacccattaccttggaatggcggatctcaactcccggcgctacttttttactcccgttcctgaaatgacgacgattacacaatccttgccagccttgatggctaagtattcaacgccccaggtcctatcgcaagtaccctaaaaaaagcgccccgcggggcgctttttttatttctgggcctggtaagctttaaccccacgaactaagcgggctaaggcgtcttcaatgacggtggttgggtaagctaggttaacccggacaaagccctttccgtttccccggtactcagttcccggcgtcaggagcaagccggtttgttccctcaagaaggcaacgagagtgcgggagtcctccgcaacggcttgggtgtctaaccaaactaggtacgtccctcgtcccggtactaagctaagttcgggaaggtcagttgccaaaacctgttgtacgagttgacggtggtgtttaatgagggctttaagttggtggacccactcaccaccgttttcgtatgcggcaatcgaagccgggatggccagtaggttgggacccacgatcccctgttggttagctgcctgggcaaaccggccccgtaataaggggttggcgatgatggcggtcgccgcttgtaaggaagcgaggttaaaggtcttggaggttgatacgagggtaattacgttactcaaaatgactggatctaaagagaaggttggcgtgtagtcttccccctcaataaccaggtcaccgtggatttcatcagcaacgaccaacaccccgtattggttggctaagcgaatcatccgttccaggtccattttcgaccaaaccatcccagttgggttgtgggggttgcagatgataaacatgcgggtcttggtgtcggctagtttttcctctaggtcggcccagttgatttggtaggcgtggttttccctatcgtaatcttgttggctagcgactaccttacgcccggttttttcaatcgccccgaaaaaggaattgtatatcggctccagcatgacgattccgtcgcccggggccgtaaagtaattcaagcaagccgttaacgccgggatgaccccgctcacgtattgcatccaagctggggcgacgtctaccccgtgctcctgttggtaccaggaagcgacggcggtaaagtactcgtccggggtgtattcatagccaaagttaccgcgggcaaccttggcttgcattgccgcctcaatttccggtgccacccggaaatccatgtcggcaatcgttaggggcagctcgccgtctttaacgcgccacttgatcgaattagtgtggcgccggtctaagttagtggtgaagtcgtaaatggtcatctggcattctccttaaaaatgaaatttctttaatgatagcacggattgacccagtaagtacccttgagcgctggttttacttttggtggaaatggggggagcttctgttccctcctaaaaattatcgaaaaaccaatcaaagtttgtgatccttccgttagtttaaaaaatagtgtccgaaagttaaacgctcatttcacaagttaggaatggtgatcagatttgcaaaaatgcactaattaaggcctaaatggctagaataatcaaattagctagataaataattcacgatggtgatcacttttgcttaacaatcatcgcccttttgacttaaaactaaatgatagcgcttgcaaaatgaaaatgagcatgttatatttcaggtgtagaaacgtcacacaggtcgaaacaggaggttcatgaagatgaaagctgcagtttggcatggtgcaaaagacattcgggttgaagatgttgatctgaaaccaactaaggataacgaagtggtggttaaggttgcctggactggaatttgtgggagtgacctccacgaataccaagagggaccaatcttcatcccggtcggccacaaggataaattaaccggtggtgaagctccggtgaccttgggccacgaattttgcggggtaattgaaaaggttggtaaagacgttaccaagtttaaggttggcgaccacgttagcgttaacccgactgtcacccacggcaaggtgcccgacaacgttgacgtatacgatggctactccttcatcggacttgcttgcgatggtggtttagcgccgttagttaacatcccggaagaaaacctctacctacttccaaaggacttcccgttgcggattgcagccaccattgaaccaacggcggtggccgttcaagccatcaaggaaggtggcctcaagtttggtgaaaacgtggccatcttcggggctggtccaattggggtcttggtagcggcggcggccaaggcggccggggcctccaagatcattgtttccgacctgtcagaggttcgtttgaagaaggcccttgaaatgggggcgaccgacgtcatcaagtccgaccaagaagacgccgtaaagaagattaaagagctcgttccgggcggggtcgacgtctcctttgaagtggctggggtaaagccaacctttgaccaagccatcgaagccactaaggcacggggtacgatggtaattgtggccatttacggccacccaatcgaatttaacccaatgcagctgaccaataccggggttaagatcaccagcacaatcgcttactcccgggaaaccttccaacaaacggtcgacctggttaccaagggctcgttggttgtggaaccggtcatcaccaaggaaatcacgatcgaccaagtggtatccgatgggtttgaagccctcatcaatgataaggcccaagcaaagattttgatcaacgtcgatggcgaagacgactagttaaaacagtaaaaaagagactggaaaacgcagcgtttccagtctctttttgcgttagtagataatcgaggcatgtcccaggttctccgtcatcaggcatcgacgtcaataacgaccttccccatgctctggccagaggcgaggtaagcgtgggcggccggcaggtccctaagggcaaagatgcggtcgggtttcgcggctacctgatacctctgcaggtaggagaagagttcgttaatcttttcttctgtgaccgcccccgagtagcccccggtcaggtaggcgcccggggcaatgtcggtgatcgggtcaaaatgctctagggtccactggttgccgagtagccccgtcacgcagacgatcccgccctcattaatgtgggtgaaggtttccttaaccgtcaccggcccgatcaattcaaggaccttatcaaatttttccgccgtttggagatgcccattttggtccttaatcacggttgagtaaccagcgtccttcatccgcgcggctttggcaagtgagcgtgaggtgccggcgacgtaggcttgggggtccttggcccggatcaaatttagcatggcgatcccgaccccactggtaccaccgcgaattaagtagaggtcgccaggagcgggccggaggttctttaacgaagtgtaggtggtgtagtaattctcgggaaagacggccagctgggaccaaggaaggtcggttgtgaccgggtaaatttgttggttaggtaacagggcgtactcggcgtaactaccgtcaaagttgctccccatctcccccatgatggaaatgacggcttgtccaacgggtagtcgttgcgggtcggtcgtttgggcgatctcccccaccccttcgatgccgagaatgcgggggaaatgcaccgttggcgattgcccctttctagtgtagacctccgagtggttaagaccaaaggcgtgaatcttaaccagtgaccacccagggcgaagttgcggggttggtaggtcaacgagttttagttagtcgggtcccccggcctggtaaatgacaatcgctttcatcagggcgcctcctcattatttagtgctaaaccgtggtcgaagaaaatgctgcaggattcgtaaaatggcgatgctaaccagggtcagggcgaccgtcatgatgatcccccataacaaggggggcaactgctgggtttggaggccttcaaacagcaagtttcctagcccgccggcgttgatggtggcggcgatcgtagcaatcgacatcgttgacgctagggctacttggaggcccgagaaaatcgccggggtcgccagcggtagttgaaccttgaaaaagacctgccggctagtcatccccattccgtaggcaacctcaactaagctagggtcaattgcccggagtccggtaataaaggtccgcaaaaggacgtactcactgtaaacgactaagacaacggtagcagtagtgtcgcccaacccggttagcggtaggagcaaggcgaaaaaggcgaagctcggcaccgaatacagcagggaaaagacgtaggttaacccagtcaacagccggtcgtggcgtaagcacagcaggattaagagggtggcgatcaacagggcaatcaatagcgacgttaagacgagctgggcgtgctgggcggtatcagttagaatggtggtggcgttttggttccaataagtaatcattgcagtcgcctccagagttcctggttacgctcctcggttgccagtagctcttcaacaaaggggctcgccgggtgttggacgatcgtttccgggctggcaaactgttcgaggcgtcccctgttcatcaccatgacccgctgccccaaataaagcgcctcgttaatgtcgtgggtaacaaagaaaaaggtcttatcggcaagcgaagcgtggaggtttttgatttccttttgcaaatcaatccgggttaaggcatctagggcgccgagcggttcgtcaaagaggatgaaatcggggttggcggccagggcgcgggcgaggccgacacgttgctgctgccccccggataactgggcggggtagcgatcagcgtactggtcgctgggaagtttgactaggtacaatagttcgtcaactcgctggtcaattttagcttgctcccaccccaacagcttaggaacaacggcgatgttttgcttgattgtcaggtggggaaagagggcaatctgttggaccacgtagccgatgtggcgccgcaggtccacttggttgtgctccgttaattctttaccaccgatcttaaccgtgccgctggtcggttgccaaagaccgttgatcattttgagggtcgtcgtcttccccgagccagatgaccccagcacggtcacgaactcccccttgttaatggtaaaggacaggtccgggatgaccgttgtttgaccgaagcgcttaacgacgtgttcaaattcaatttcgggttggttcatggttttccacctttcggatgaggaggtcgaagccgaccattgtgattaaagagagcatggcgacgctagccccaccaatgatcacgtcggccatgtcgtacaggcctaagccggtaaagatcagggtgcctaacccgccggcgccgatataggttgctaaagtggcactagcaatgatttcaatcagggcgagcttaatcccgtttaatagatagggcagggctaagggaacttttacttgccaaagcagttggcgttcgttcattccgagggcgacccctacttcttggtagatcgtcccaacttcattaaagcctaggatcgtgttgattaaaattggtgggatggcaagaatgaccagggcgattccggccgggacaactccggttccaatcagcggaatcaagaggaataagagccccaagctggggatgatccgcaagatctgggaaaatgatgaacaaattagggccaccttggggtgttttgagccgaggtaccctagcggcaggctgatcagcatggcaatcactaagaccgaaaagctcagtaccaggtgttggcccacgtagccccagtactgggcgtggttagtttgaaagtaatggatgatttgcgtaagcacggtcaggacctccggtattaataaagaagaaagtggcaataactgacctagatcagctagaattgctgtgatgggggcgtattctccgcctaatcagcatagaatagtaaggggccgggagaaaattgaattttcccctagcccccaatcctagttaatatttttattaaaccagttcttagccacagtttggtagttttgcccgtcgacgtcaacttttttgtttaattccgtcagggttttagttgttaacttcttgtcgacctgatttaaggccttagccatcttcgggtgcgacttgagggtcgaattccgaaccaacgggaccaagttataggctggccacaggtgcttgtcatcctttaagagggtgtatttgttgccattggccagttgcccgtcggtagtcgagaccggcgccgcatcccccttgccttcggagaggatcttgtatttcaagctgtcatcgtagtcctttgaggacttgaagtcgaacttaccgtactttttaaccatccccggcagggcgtcggcccgttggtcaaattccccttgcgagacgaagcgaattttgttggccttcttttgcaggtcgctgatcgtgtagaggccgtactttttggctaccttggtggtaacggcgatcccctgtgaatcattacccggtgccggtgttagggtcgttaacttatacttggcgacccccttcttggcggccgccgcaatttgcttagcgttcttattggtggtgctttgctttaagtaggcgtccacaattgtccccgtatactcggggtaaacgtcaatttgcccggtttggaccgccttaaaaacgaccgaattagagatattttgtttacgggtcaccttgtaaccggccttttccagggccagggcgtaaatttcactgacgaccttactctcggtgaaactcttggacccgacgataatcggggtcttactattagcggcgaacccggttgttggaagggctagggcccccaaagcagtgacggcaacggtggccaccagtcgccgaacccatttcctcatattgatcgctcctttttcttagtacttgtgatttcataagtaacaataacacaatcgaatagcttattcaaggctggtgtgataggattaggttatcaaagtgtttttacttgtaattaataatggaacgaggtgagaaaatgcgtacttcaacccgctttagcgatgctatccatattttgtgctttctgaaggtttacgaggaggcccgaatcacgagtgacctcttatcatcgagtatcgggatctcaccggtcatggtacggcggttaatggggaacctacggcaggctggcttagtccaaactacccaagggacggcacagccacggttggctagggacctgcagaagattaccttatacgatgtttatttggccgtcgaagagagcgatggtccccaccccctcttcaacgttaaccccgatactaacccccagtgtaaggtcggtggtcacattcaaccaatcctagccgaggtataccaagaggcacaggcggcagcgatgattcggttcaataacgtaaccgtagccgatatcgtggaccagatcaacttaaagttgcaccaagaaaagttacaagactaaaaaggagcgttcacgatttcccgtagcgctcctttttctattcaattcgctttgcctccattgaaaagacaacccggtcgctcaaactgttgtgaaccgtgcagtacttatccatcgtctttaggagccggtcaatcgccttatccgtcattgaggtcgctaacttaaccgtcacgtgaacggtggcaagggccttagcccggctccctggtaggtaatcggtggtcccttcaatctcgagctcaaagcgattgacgtctagttgcttgtggcggatcacgtctaaggcggtcagcgacaggcaacccccgagggcccccaataaggattgaaccgggtttggcgctgcatccgtcccttcttgggtcaacggttcgtcaagtaaccactggtgggtgccgtcgttattgatgacttggcaacccacctggcgtaaaacggtgtgaatttggtaatcggccattagtcttcctccgtcatgtccttcattaaaatgaaatcggtctgcgggtcatcgcccaccatgaaggtatgttgactaacccgcttaaagccgtagcacccatagatcttttgggccgggtagttatgttcccgcacccctaaccagacccgcgggacgcccgattttttagcttcttgcatggcaaaatccattatctgccgccatgggtggtgaccttggtatttaacccgcaggtagatgcgctgtaattccatggcgttggggtaatccggttcggtttgggcgtccttccaggaaagcttcaagaagccaaccacttccccctcttcgtttttaaagaagtaggtagcggtgttgggatcggttaattccgcttccattgactcggtggtgtagtattcctttaaaaaggccgccatctcgtctggcggggtgttagcgtcaaaggtcgccttaaaggtttcccaggctaactattgtaagaccctcattgaggcgggatcggtggtaactagttcgggggtaattttcattgggcaaactccttaacttttcttccattataaaccgaattaaaactaggcgctattaaatgcccagcccgcctagcttagtgcttcaacttcaattggttctcacgctgctccccgggaattaccacgaagacaatgattaccagggcaatagcggcgcagatcgttgacattaatagtgattgacgataagaagcccccccatgggtcatcccaccggtaaccccaacgattaaggcaaggccaacgctggaaccgatctggtgcatcgtgttaatcaacccagaagcggcaccggcatcttcgggaagcgtgttagcgaccccggcatcggtataaaagggggccaggtgaccggcgaaattagtgagttggtttaagaactgcttgaccgggaccgctggctggcccgaccaaaccggggaccccactaaaataaggttatactgatccagttccggaattgggtttgccagcggtggcagctcaccggtcgcaagctggttcttggcgcggtcggaagtggcgtacatatcagttaagtcataagtgcctgccgggaccgcaatttggtattggtcagctcctggcaagagcttggcaatttggtcggctaagcgtttggtgtggccagaccaagagtaagtggcgattaaaatcttcttttccatccaaaaccctccttaaagtaaggataaatgaagcggtgcaccccttcaatttcgtttacgggggttaaccattaccaaaactgattaataaactggtcgggtggcgccttccgtagtgggatcgccaatcccaagactatcgttagctcccagggatgggtcggcaatgatgcggtagatcacgtcggcaatgcttcggcgggatcccgacaccccgacgaactggtcgtggcggtgcgtcagggtgtaattaacctccggccggtcgttaagccacggtaagcgtaaggggtataagttaaaccagactccgctagcagttgatcggccagtaccgccgtagtcccggttccagtccccgaatttaccgggcacttcgttgtagaggcccagtaggctggtttctaccacccgctcgaccccgtttaacttggcggccgcaatgatgtttttggttggccggttagtttggtcgtgatccacgacggccgaccggattaaatcggcgtcctttgtcgcctgaatgacgtcagtgggattcgttaaatccccgtctaacagggtcacccacgggttgtcgttcaattcagaaagtcgttccggatgacggagcatcagggttaattggatgtctttaaaggttggttcagttaacagccgttcttcaactaggtgggcaatctgcccgttggcagctaaaatggtaacgttcataagttccgcctcttaattgactgatggtcattatttttgataaaaaaggggcgcccctattttactaagtaaggcgctagcatggaaccgagggcgacatcgcagtagtcgcgtaagcgttgttcagggcttgcttggtcatcaaccccccaagcgactaaaatgccatagagttccaccgttaaaaggttggcgatggttgccacaggggttgacgccgttaaacgttggtggtcaaccaacccttgtaagagtcgttcaatcccccgccggtcgttttcaaacttaccaatttgtccattagaggggtccaagataaagcgaagccaactccggaccatggctaaggtcgattgatcggtgaccaccttgaggtaactcattaagtagtgacgaatcccttcgactggatcgccgttaaccagaagcgggatttggtcattaatcgccgcaaatcggtgttgactcagggcgatcattaagtcccccttctttttaaagtaggtataaaaggttcccttagaaaccccggccagcttggtaattcgttcgaccgacaccgctgcgtagccttccttaacgattagttggtccgccgccgttagtagtttttgcttggttaagcggacttgttcttcacgcttcaaagtgcacctccctttccttgatgctcgtatcatacaacataattgactggcggtcaattatgttagagcgaaaacttggataagccctattttcatctacttaacataatgtaattagttgatactgccgaagtcgatttgatccagcaggtcttccctactctgctggtcgagccccaagtaggccaaggtcatcgcctcgctggaatggttgagcagcttcattacgagtccaatgttgtaattggactgtacgtacacccggtaagcaccagttttacgcatcgtgtgggtaccgaggtagtttaagccgagtaaatcccccaccttgtgcatgactttatagtactgatgctcggtaatgtggcgttccgggcgttgaaaggagggaaaaagccattcgctggtataaacctggcagtccgggttagctaattggtagttggtcaaccaacggacgtagcgcttgaggtctttttcgaccggcttcaaataaagggtgttttgcttgcgggttttcttgtcgacgatgaaggcgttgcgtcgtacctccccttcttcatcaaacacgtcagccttttttaaactgataacgtcggacacccgcaacagggtcgccttcccgacttggaagatcgtgtagttgcgttgaccaaacttgaaattgtcacgcaaggtcgctaatacctgggataacatctgggagtccttaatggggagtaccaactgcttcaaaagatcacttctttcctgggggctgttttttatctatcctcaattatagtcctcatcaccaaaaccgtcaattttagatcctattaaaacggcattctcgggggcctatttgtatattataggccccattttggcgccacaaatccccaggacagtaaattcactctcagacaaaatttcagtcgggttaatgggcacttgtccgtttcattatcgctgaacgtcaaatcatttaattaacataatataatttaaacaacttctcccctactaaaaaatcccccgctaagggaggattacagctggtgtaaaaattgactcactacttgattgaagacggctacctgttcggccatgacgacgtggccggactggtcaattgaaacgtgatggaccattgggttatccttagccaccgttgcgtaggctgattggtaaaaggggctttggttggcggtcaccaataaggtcggcaccttggtggttgctagggttggccggaagtcttggcgcgcgacgtcggtgactagttcccggttggccgcccggtcgaaaggaaactgctgtttaactacccggagttgatcataaacgtgttggtcgatgccgtgtagcgtttctgatacgccgggtgcaagtagaccctgctggtagttggcacgggtaaccttcatgaagccatagggccaagatggcgaattaatcaggcgcgggctctggtcgacggccactacccccgctaacggatagttagggtaccaagttaagaagtcatagatgacactagcccccattgagtgaccaatcaagatggggtggttgatggttggcaaagcgagcaactcttggaggtccctactgaggcggtgaatgctgtcgaggttgggatcaaactgggaggcaccgtgattacgttggtcgtaggttacgacctgatagccatggctggtaaagtattcaacttgacgcgtccaaacttgctggtagccaccaaagccgtggatgaagaccaggctttggccgtgaccaacgacttggtagttaaggcggagtccatcatcagtccttagttccatgatcattatccccttccatcacactggccaaaaagatggtggcaatcaggaggtcggccgccccacccagactgaggtggcggtcagaaaagtccttctctaggttgaccaagaattgacgaccttgtttcgttgttagaccaccgagctcaaagaaacggtctaactgttggtccttccatgctaagatggctgggtccccggcccgcttaactagggtcgtgtcatcggtgtggcgggcaatcttcaagaaggtggttagctggcggtcattttggttcatcccccagttagcccgccaggtcggcaggccatacttgaaaacggttgggaaaccgctcgccgcttccccccggatcccggtttgcccgtaggctaggtactggcgctccccggcggtcagctgttggccatgctttaagccatccaggtcggtcgccaataggttagccaacatctctttgacaacccgttgaacgttcaactgggtaactggcaactgacgccccttcagcgtcgctacggccccggtcaaaatgcccagcgaaaaaatggtgcccttgtgagtattaacccccgctgttgctttgaacatcgtcgtttcggcccgctgaccgaggaggcgaagttggttaaagaaaaggggcacaggttgtacggtcgggaaattgaggccggccgtggccgcccgcttaaagtaggggcgcagactggtggcgctttgaataaaggtgaagacatccatatctgggtgggcgcggtgctcaactgggtcaaccaatcctggtttgggccaggtgacgacttcgtttaacattgccttcaccgcttggtctgccagttgctcagcaacagtctcccgttggttagccgcggttgcttcgtcaattagtttggccaccctggcttgtagttcttcaacgctgtggcgccgtgaccgtccacattccttagccgggcgcccgcagattagacaggtccgaactggaagatcaaaatccccccgcgaaagtgagtgggattccccgccgttggtgattaacacatcgaggtcaaagagccggttggctggttggcgctcttcgaagtggacggtcccctccttgacggttacgccagcgctatataataggtagaaacgttccggaccggttggagcatcctcccaagaagtcgcaatttcaaagggttgtccgcacgctagccactggtcctcaaggcgtgctaagccggcggtaaagaaggcttggatggcagcgctgttcttgactggccccgggatatttagcttgcaggcgaccaccacctgagaagggtgttctcttaataactgtgcctgcgtggctacccgccggtcgcggttggctaagaccgctgggatctctacattggtaccttcaaataccttgctcaccattgttagttcctcctaattatattatgtaaagaaattatattatgtaaagaaaagggtaccggatcaaggtaaccctattctgaatggcaagcgaccgaggcaaattgccccagccactcactcggatatgtcatttaagattggcagtttcggcgcttagtcctttacttgcttgatagcgtcaattaggctaccgtcacgatattcgactaggccgacgacgcggtcggtgtattcaatcggcgccggcttgccaaccgtagcttcggcccgcttttgcagttcttcaattgaaacgattggtaaacttggcaccttgctgaaggcgttaacgaggtcttggcgagctgggttgatggcgatcccgacttcggttaccaggacgtcaatggatgcccccggcgttgaaacggagttaacgctaggtacaaccgtggcgatccggccccgggttaacggcgcggagatgatcgtcatcttggcggttccggcgtcttggtgaccaccaacggccccgcggatttccccgttggaaccggtcaagacgttaacgttaaagtcagtgtcgatttccagggcggacaggatgcagacgtcgagttggtcaaccatggcccccttgttttcagggtcagcgtaccaagaagcgtcgatttcggcttggcccgggttgctcttcattgaagaagcggcgcccttatcgaagtcttggacgtccatgaccttcttaaccaaaccggcttccaaaaggtcgacgattggagaggtcgtccccccacaagtaaaggcggcggtaataccggccttcttcatcgattcgccaaggaacttagttacggccagggcggcgccaccagtcccggtttggaaggagaagtcctgtttgaagtatggcgagtgggtgatcacgtcgttaaccatccgggcgatcttcaattccttcgggtcctttgtgaagcgggtcgccccactcccaatccggtctgggtcccccacccggtcaaccttgaccacgtagtcgacttgggtttgttcgattgaagccggggtgttggggtaatcgacgattgtgtcggttaacaaaacgaccttgttggcgtacttggcgtcaatcagggcgtaccccattgaaccaaaggcagattcaccttccatcccgttggcgttccccagccggtcggcattcggcaccccgaggaaggcgacgtcaatcttgatgttcccgttttcgattgagcgggcccggttcccgtgggagcggaagataaccgggttcttcaaaagaccgtgggaaacttgttcacccagttcaccacgcatcccggacgtcgtgatgttggtgacggtgccagccttgatggcttcgatcaccttgtcgttcatcacgttagtcaaagaagagggagccaaggttaagtccttgtagcccagcttgatgatccggtccatcaccaggttgaagacaaagtccccttcccggaagtggtggtggaaggagatcgtcatcccgtcttgtaagacgtccttgatgacttcatcaacggaggaaatcaccttgtcgtcaccggttgaaacccggaccttaggggcgacccggctgatcaccgggttaccaatttccgttgattggtacggttggtagttcaattccttcatttctgcgtcgggaagttcccgtcctaaactattcttcaatgaattcaccctcctcgttaattaagtttgaagccttggctaagcgcaggacccgttgtgcccgcaaaacaaccggccggtccaccatttgaccgttcattgagatgaccccggaaccgttttggtgggcttcttcgatggcggcttcaacgtccaaggcgttttcaatttccttcttggttggttggtaaacctcgttcacccattcaatttggcgtgggttaaccagggacttaccgtcgaaaccaagttcgtggatgtgttccgtttcccgcttgaagccggccacgtcgttcatgttggtgaagacagtgtcgaaggcggcgataccagcggcccgggcggcgtgaaggatcatgttacgggcaaattcaagttccgccccgtctgggtaacggtgcgtcttcatgtcggtagtgtagtcttcggcggacagggccaaaccgatcatccggtcggtggattcggcgatttccaaggccttcatgactccccgtgccgattcaatggcggccatcaccttagtgccggaaacgccaaacttggcttcggcttcttcgatcaccttgaccaggtccgacatcatttgggcggattcaacctttggtaagcggacaacgtcgatgccggccttaaccatggcaaagacgtcgtttttaaagtagggcgtgtcaatcccgttaacccggaccaccaattcggcatccccgtaatcctgggtcttcaaagcttcataaaccaagactcgggcggcgtctttttgggacaaggccactgagtcttccaagtcaaacattatcgagtcggcaccgtaaataccggcgtccttgaccatggccgggttgttccccggcacgaacatcatcgtccgacgtaaacgttcttccattattagaacacctcccaagcgggttgatccgtcgtttctagggcacgttgggcggcggctaaggcccgggccttaacgacgcaatctaaagcgcccttatcaacggccttgacgtttgcgttttcgatgccagtggccattaacgtatcggtgatgaccttcttaatttggtcgccatatagggatgcgacggacgaatcaaggtcgatttggatgccatcttgaccggtgctaatggtgatctggatatcagatgattccagggtgcccaccatggcggtagttttaatttccatttcaaaatccttccttttgctgagtggtgatgcgtgcttgtagagatgctaaatgttcttgaatgaaggcgaaagttgttggtggcaggtcgtcttggacccgggcaagctccccgtctttgatggcttggcgaacccgggtggccgaaatcaccacccctgcttggtcttggcagcgctcaatgacgtgcaacttcacacggggcgccaaaacttccgccagggcccggttatagttagccgtcgtcttagaatggggttcagtccccacgtagcgagcggtgatctttaacgccggggcgatctgggtcgcaaacaactgggcatccagatgcgcttggtagtcgccgatttcttgatcagactttaaaaagtaggcgggaaaggtggcggggctaatttggtaatccccgccatcgacaacgaccacgttggttaggtcgctgacccccgctgccacgagttccttgcgctcgcgggttttaaatagagagacgtcattgctgaccacgaacaggtaaactaacgcgctctggctggccgcttgttcgactaagtaacggtgccccttggtgaaggggttagcgttcataacaatcgccgccacttgcccctgactcggtgcgggctgcttgacctggctaaggtaatctttgatcgtgggcattcccgtttcgagcagggcggcttgcggtgtttgggcgagtagtgcgaagccgacgtgggtgaagctggttacgtattggggtttagtgaagacaaagaggtgaaagtgtccccgttgcgccgctagttcggtcaagtgactgacgacggtgttaaaaaaggctccaccctcacgatggtgcgcgctgatcgcaaggtactttaacacctggccagctaccgacccggtcgcaatcaattcgccctggtcgtcaaaccaaaggcaagtggtatcaattgccgcaaggtcggcgtccgagaagccgtgaacaccattttcctgtaaaaagtgctgccacaactgacggtagcgcccctgcttgacgttaacttgcttaacttccattgtgcgaacccctctaaggacattgttggtttaattgtactacaagcaaaaataactaaagcgataaaattcccatgatgattggtaccacgatcacgaacaaacatgaagttgccaccaccatgctggtcgcaaacttgacgtcgctgtggtattggtcggccaagattggcaaaacggcaaatgatggcgtggcggcctggatgatcagggtcttagaaaacatcgatgccatgttgacgtggagtccgtgggcaccggcgtagatcagggtaaacataatgattggggatagcacgaagcgaccgaggatggcgacgttgaggttcttgctgaagcgaacgctttggatcccgaagtccttgagcatgatcccaatgtaaatcaatgataatggcgtaactaaggcgccgacatcagtcaaagtggtggtaacaaaggttggtaactgggtagcggcgtttggcatccagattaagaacggaatcgccacgataaagccccacagcggtgctggcaagaagtgcttccaatcgatggagaccttattcttagttgttgggtcgtaagcggcgatcacccacaccccgaaggtccagatgacgatcgtgttcacgatgtagtaaaccaagaggtacgggatcgaaacgttgccgaacagggccacgttcagcggcatcccgatgaaaacggtgttcgccccgttgatcccggtcatcacgagcccccgttggttagcgggcacccggcaaaccacaactaagagccagctgatgatgtagccaatcacgaaggcgatgatgacgtagacgagcccgactgacaacgactttaactgcgagatcttaaaccggtccagcattgacatgaagatgctacaaggtagggcgaccttcatgatgatctgggacagcgacttggagaagtggtcgtcaaaccacccttttcccttacatacgtaaccgatcgccatcatgatgatgatcgataagacactttgaattgaggtccaaaagacagccattatttatttcacttcctgaattttacaatctgccaagattaaatagaattctatccagacgaaaaatttggatagaaaaaaggcaatggacccggtactgttttaagtgacaaaactataaacaataggagtccattacccatgaatcatattttaacattatcggatagaactgtcatccaaacgctacttaaggttggttactcacaaaaacaaattgctgaagaagttggtgtagctccttcaaccatcaactatgaactaaaacgctgtcctaagggatactatgacgctgatcaagctccggaagactgcgaaaagaagctaactcaccgggggcggaaaactcttctaacagagaatttaagagaattcgtccgtgggatcattctcgaacagcggtggagttttgaagttatcgcgcatattctccaaatgccattcaaaaccctctataactggctggacaagggctggttggaatcaaacgcgaggtccttccagaccacggtgtgcggtaccgaaagagccacgatggtcgtggtcagtacacacgtggggcgaagtttatcaaccaacgcccggacgaggctaacctgcgtcaagagattggtcattttgaagtcgataccatcctatcaggaaaaaccaggggtgaggtcctagctaccctttactgatcgtaagtcccgactaatgattattcgtcgtttaccgggacgtgatagtaaagctatgactaaggcaatcctagagcttaacgaggagttgcgcggcttgatcaagtcaatctccagtgatcacggtaaggaattcgcaggcttcaaggaaattgaagcctacggaattgcccattattttgcccacccgtatgcgccacatgaacgcggaaccaacgaacggttgaaccgcgagcttcggctacacattccaaagaaccagtcaattgagagcgttacagacgaagagctgaccatgatctcaaagtacttgaactggcgtcctcggaaatgtttggggtggaaaatgccactccaagtcttctttggtgacttgtccgaaaaattcgattaattgttgcaatctaccgttaatttaaatttttgaggaagttttccactacctgattaaaggcgccaactttctccgccatgattacgtggccgccttggttgattgcaacgtgggaaatgacggggttatccttggctacttgcgcatacttaccccggtaaaagggactttggttggcggtaaccaggagggttgggaccttagtctttgctaaagttgaccgataatcctggcgggccacatcagctaccaattcctggttggcgtcccggttaaaggggtactgctgcctagcgactttaagcagatcgaaaacgtaggggtcaatcccgtttaaggtttccgaacaccctgggtgcaacaaaccctgccggtaatttgtccgggtaacctgcatatagccatagggccagctgggggtgttgattaactttgggctctagtcaactgccaccacccccgccagtgggtggtcagggtattgccttaggaaatcgtaaatcacactggcccccatcgagtggccaatcaggacgggctcctgaatgttgggtagggagaggacgttcttgaggtcctgactaagccgatgaatgctggtcaggttggggtcaaactgggaggcgccgtgattccgctggtcataggtggtgacttggtagccccggctggaaaagtaatccacctggcgggcccagacctgctggtagcccccaaagccatgaaggaaaatcaaagacggtcccctacccgtctgctggtagttcaggcggacgccatcatcagtcgttaagttcatcgttgtccgctccttccatcaccttggcgaggaagatggtgacgattaacaggtcggccgcccccctaaactgaggtggctggcggaaaaggttgtctccagtgcggtcagaaactggagaccttcagacgttcctaattcgcccagatcaaagaggtgatcgagctgttggtccttccacttgaggatggccgggtcccccgcccgcttgatcagggttgaatcttccgtgtgccgggccatcaccagcaaggcttccagttggcggtcgttttgcgttgccccttgcctgttgaccagggttggcaaaccatattcaaaaatggtggggaatccactagccgcctcgccacgaatcccggtgtgaccataggtaaggtactgttattcccccaccgtcagtttggtgtcttttttttacccgtccaggtcggtagctaacagatcagccagcatttgacggacaacacgttgcagattagcctggttaatcatttggttaccttgcttaaggacgcccactgcgccggtaaggattctgagtgaaaaaatggtctaacccccttggttgccgcaaacatggtctatttagcctttaagccaaggtggcgaagttggtcaaacaagcgggttaagggctgtcccactggaaagtgaattcccgcctgggcagcctggtaaaagtagggacggaggctggtggcgcttttgataaaggtgaagacatccatgtcggggtgggcaccgtgctcaaccgggtccaccagtccgggtttgggccaggtcaccacctcactaagcatggcttccacccactgttcctcttagtttgcttggatggcctgcttaattaataccgccactcgctcctgaagtcctgcgacggtgtgccggcgggaccggccacattccttggcgggacggccacagatcagacaggtccgaacgggaaggtttaactccccgcgcgaaagcgaatgggcagtttcgccttctttaattaagacgtccaggttaaagagacggttatagggggtggtttcttcaaaagctactgtcccctccttaaccgcaatcccgttcccgttaagaggtaaaaggcctccggaccggtagctgagttaaaccactggtccgcaaggctatataattacccagttaccaaccactgatcttcaaggcgatgcaaccccgcttcaaaaagcgacgaattaacgggctcgttttgaacggacccgggatgttcagtttagcagccaccagaacctgattggggttctccctcaagagctgactttgctttgctactcgtcggtcccgattcatcaggacggccgggatatcctgttgggggccgtcaaatacgttggtgttcatagttttaatccctcttagtttatataattagaattataacacagatttatggttcctccttcttcggttttgcaacgttcattagggtcaccactgccgtcgccgttaatcggttgctaactagcaacttcgcctgccaggtctgaagtgtgcgaccaacgtgatcaggggttgcaaccacaaaaatctccccttcccgtatcgcacggatatgttgtgtggtaacattaaccccgaccgcgattcgccccggcgctacgttggcgttagcccctagggaggccgcggtttccgccagcacggtgttaattccgccgtgaacgatcccgtacggttgcaagtgctttgcttggaccggcatggagagttcaacgcggtttttggtcaccaagtcctggtgaatgcctaagttttcaagtaaattcatttttgtacctctggattttgtaaaggagtttgttatgacgagtgctaactggacccccgttaaggagtattccgaaattatttttgaacgcgacgataagatcgccaagattacgatgaaccggccggaaaagcacaatgccttcaccccggtaacggtcgccgaaatgatcgacgcgtttaacatctgtcgtgatgatagcacaattggagtgattattcttaccggagctggcgataaggccttttcttccggtggtgaccaatccgtgcggggtaatgggggttacgtgggccccgaccacattgcccggctcaacgttttggacctccaacacttgattcggatcatccccaagccggtaattgccatggtcaagggctggtcagtcgggggcgggaacgtcttacaactggtttgtgacctaacgatcgccgccgacaacgccatgtttgggcaaacggggccgaaggtgggttcctttgacgccggttatggctcgggttacctagcccgggtgatcggccacaagcgggccaaggaagtttggttcttaaaccacttctacacggctgacgaagcttaccaaatgaactggattaacaaggtggcgcccctagctgaggtcgaatcagttactttagactggtgtcatgaaatcttaaagaagtcaccgaccgcctttcgcttcattaaggcggccatgaacgccgatacagatggtttagcggggcttcaacaatttgccggtgacgccacgatgctttactacacgactgacgaaggaaaggaagggcgcgacgcctttaaccaaaagcgcgaccccgacttcgataagttcccgaagttcccgtaggaggccgtcatggagattccaaattggctcctcaaacaggcttcgctaaaccctaaccgggtggcggttaacgacggtaccaccgcctacacctttgcccagctggttcccctggtcgcccaccgtgctggccagattcaagcgcagacggaccagccccgggttggggtgatgacccacaataacctggctggttacttagccgccctaggggtcttagccgccgacaagaccatcgtttggctaaattggcgcctcgcccctgaagaactgagtcgccaaatcggcgacgcggggttagacttggtcttagtcgatgaccaactagccgaccgctattacggtgggcaccgggtcctctgttcggaattgacagctggcactgccccggcggcagtgttgacgccgacggttgacctagacgacgtggcctcgatcatgtacacctcgggaaccaccggtcagccaaagggcgtcttgcaaacctacggcaaccacttggcctccgccatttcgttatctttgaacctcggggtattgccaaacgacctctggttgtgcgtcgcccccatcttccacatttcgggcttttcaattctaatgcggggcctgatttacgggatgggcgttcgcctagtcaaccatttcgatgcgcaagtggtcaaccaaatcctggaggacgaaccggttacgatcatttcggccgttccctacatgctaaagaagatgctcgaagacatccaagcaaatgaccactgttactcatcggcctttcgcctggtgctactcggcggtgggacgattgactgggcgacccttaacgcctgcgaagaaagtgggctgccggttgtccagtgttacgggatgaccgaaacttgctcgcagttcgttgccctctcggctgaagaggcgccttaccaccttggttcggtcggtaagcccctgtttaccacccagctgcgtttggtgggtgagcatcacgaaattgagatccagaccccggccttaaccccgggttacttaaaccaaccggccaagtttgcggctaagcacgatggcgactggtaccggaccggcgacgtcggccactttgatgaagacggtttcttgtacgtcgacggacggttagatgaaatgatcatctccgggggcgaaaacattttccccgccgaggtggaaaacgtcttgcgccagtacccaggcatccaagaaattgccgtggtcggccgtaatgatcaacagtggggcgccgttcccgtggccgtggtcgtcagcaaacaacccgtcgactttcagcagttggaggccttcgggcgtgaacacctggcccactataaggtacccaaggtctacttgcaaacagacgccctaccgaaaaacgccagcggcaaggtccaaaagtttcgcttacaagacctggtcgctaacgcttagtcatgccacaacagaataatcaattgagaaaagaaagatacaaataaatgatgaatgtaaaacccaaccgccgggccctgtcgctcggttcctttgtgattttataccttggttacatgctcttattcgccgaccggaccgtgcttaacttatcgttggccgcgatcggcaaggatttctccgttagcccggccgcactgggggcgactagttccgtcttcttcttgggctacacgatcatgcaaatcccggggggctggctgaccgaccgcttctcttcccgtaaggtgatcattgccaccctcgccttttggtcggtgatgacgatctttaccgggctggcctggtccttagccgccctcttggtaattcggttcctgtttgggatcgccgagggcccttacccaccggccgccatgaagcaagtcgcccaggacttcccggtcaacaagcgtgcccaactgaccgccgccttaatttcctctaactacgccggcgcggccctggcccctttcatcatcgtgccaatcatcgccgctaccggttggcgctcggccttcttctggttggggggctttggcctactcttgatggtcagctacctcttcttccgcggtcacggcggtggacaaacggtaacgaaacaagaacggcaaaagataaactggaaggaaatcgacccgcgggtctgggccttcgtggtgatcgggctggccttaaacattatcaccaaggggatggaaacctggatgccggtttacttcttaaacgcccgccacatcaacttagccaacttggcttggttagttcccctaccgacgattgccggggggattgcggccttgatttccggttacgtaatggtgcacatctttaaaaatcacgaacgcctgatgattatcctggcctcctttttaacggtcctgaccatgtttggactctacaagtccaccagcctggtttggttagtgatcttccaaatggccacctacttcgtcaagtcgctagccttcaccgggatcttctcctacgcggcccaactcttcccgcaaaagacttatggctcccagatcgggacgattaactttggtggccaactcgggggcttcttcggtcccctcttaatcggctggatcgttcagctgagcggttcatacgacacggccttcttcggcctggtcatctccgccttggtagccggggtggcgtccctcttcgttgggaatttaaaagctaaataatccgctaattatagaatgattaatgactgtggtgacctcgtacgggattatcacagtcattttatttatttccaatcaatttcttaactatcataatccctgttattttaactctttcatggaatgagaacgctttctttaaaattaattaaactcacatatgaagacttggttataacatgatttatgttataatgacggcaactaatcaagaaaggtggtagttatgaatgaaaggttttgcaatgctgggccgtacaataccccttagggttgacactttaaataataaaagtgtcatctctagggggtgttttgaataggaacatattcaacgacggaaaaattaaggttactcagtaattaccaagattcagactactcactcggggtatacgtggattatcaccaggtgcggacctctagccttaacagatggattaaacaatttttaacggctggtttggctggattgattcgccctgaacacaatcacaggtacacacttcaaaccaagcgattagccgttaaagcttacctttcaggtaccctgtcaggccaagcaattctcagtagatatcaaattcgtagtctttcccaactacatcaatggattgtccggtacaatagtggacaattaagtgttgcttacgcaacaagaaagcgagctaggaaagtgggccgaaaagttacttttgaggagaaacggcaaattactcaatggacaattgatcacgagtataactatcaagccgcggcagaaaaatttaatgtcagctatcaacgggtctattcatgggtacgaaagtaccaaagaactcacgattgggaatcccttcaggataaccggggtcgccataaaggcaaaacaccaaccaatgaagtggaaagattacgacaagaagtaaggcagctgaaagctaaagcgaaggaacgggaggtacagattgccttcgcaaaaaaattggtcgaaatacacaatcgggaggtggaacggccggacgatatcaagcgattcaggaaatgagccaaagtgggtataaggtatctgatctagttaaagcagccgggggtaagtcggcaggcttactacaagtggcttacccatgaaccgacggttcatgatattcaagatcaagaaattctaaagctcgttaaacagttagaagcacaacataaacactgcgttggttatgacaagatgacccgtttgataaagcaggaaagattatcatacacagttaacaagaagcgcgtcatgcgcattatgaaggaacacagtattaaagcggactatcgtcagcctaagagaaaacgtatgcaggagcaggaaacttatgaagcacagaataccctgaaccgccggtttgaacaagctgccgcaaatcaggtgtgggtgacggacacgacggaaattgcctacaacattcgtaagtacaaagtccgtctacacgttgtcctggatctatacggtcaatacccacttagctggattattacgcctacagaaacgagtactggggctattaaagtatttcaaatggccaagcagaaagccggaggtctggcaccgctaatccacactgatcgcggagcagcatatactgccaaagcattcaaccactacttggctagtaataacagccaacatagttactcagccccaggaacgccagctgataatgcggtgatggagcactggtgggctgattttaaatctatctggttagcacactcaccacaaccacaaacgtttgaagacttagaacagctggtgacagaaggtatcgattactttacgcattcctttatttcaggcaaaagaaatgaccttaccgcagcagaataccgcttcggcaaggccaactagtttttagtatttaatgtgtcaacttgacagggtacagtaccataattattggtatgaaagatacaaaaagaattacatatggtagaacgtcagtctacaattttaattatcatttaatttggggaactaaatatcgtaataaagtgttgaaaggacacgtagaagaagtcttgaagcaatcattatatgatatagcttcaaaatatggatttacgattgctcatatggagattggtaaagatgaccatatccacttactagtgagcactccgccaaaactgtctgtaactaacatcatgcgctggattaaaggcatttctgcatggcacctcttccgagaatgtccagaactacaaactagctactggaaaaagcaaggtcgtcacctatggtcaccaagttattatgttgaaagcattgggagcgttaatgaacaagcagtagccaagtgtattgatgatcaacgcaaaaaggaggtgaaattagaatgaccaaattaattaaaggggtcaagctacgcttgtaccctaacaagcaacaacaagctcaactatggcaaatgttcggcaatgaccgtagagtgtggaatctcatgctagatatggctaagcaacgctatcaaaacaatcctagcagtcattttgtaaatgaatatggaatgaattacttgcttaaacagttgaaacaagaatatccctatctcaaagacagcgatgcgactagtttccttgtggtgaaccataatctagtccaagcttttaagatgctgtttaaacatcgtggtggctatccacgctttaaaagcaggcacgccgccaaacagtcatatactggtcggtcggtctgcacagtgattgccaagagaagaatgaagctacctaagttaggaagcattcgaactagtaagacctctcaagctgtaaatggcaaaattaagcgttataccgtcagctatggtccaactggtcgctactacttatctttgcacatcgagactgttgctccagaagcattgccaaaaacaggcaagaccgttggcctggatgttgggatcgctgacttagcgattagttctgacggtgaaaagtttggtactttcaatgctaagtggttggaaaagcaagccacaaagtggcaaagcaagtatagtcgccgaaaatatcaagcaaccgtagctgttcgccaatggaaccataatcataaagacgtaaaaatggatctcaatgattatcagaattggcaacaggctcaaaaacaaaaggctcgctaccaacaacggatagcgaaccaacgtcaagattacttacacaaactaacaacagccttagttaaaaaatacgatgtgattgtcattgaagatttgaaagccaagaatctacaaaagaatcaccatttagctaaagctattgcgaatgccagttggtaccaatttagaaccatgctggaatacaagtgtgattggtacggtaaacagttaattactgttaatcctaattacaccagtcagatctgtagcacgtgtggttaccatagtgggaagaaaccacttgaaattagagaatggacttgtcctaaatgtggtactcatcacgatcgagatattaatgcggcagttaatatactccatagaggattaaaagccgttggctagggactagccgtggtaaaagaacggagttctgtaagttaggtattctgaatacagaagcaacatcctaaatactacttcgtgttcccagaagctcggtcatttatggccgagtagttcactattatgacagttggtccagggcttgctgtaagtctgccacgaggtcttcttcgtcttcgatcccaaccgacaagcggattaattcgtccttaatcccgttttgcaggcggacctcacgcggaatggaaccgtgggtcatcaccgccggcacttcaatcaggctctcgatcccaccgaggctttcggccagcgtgatcacctgcaggctttcgacaaacttctttgccgagagccccgcttgcagttcaaaggacaccatggcgccgaagtggtccatttgcttagccgcgatatcatgtcccgggaaatctggcagccccgggtacagtacccgagcaacccgcgggtccttttccaacagttcaatgacggcggcggtgttttcatggtggatccgcattcgggcgccgagggtcttaatcccccgcatcagaagccaggagtcatcgggcccaaggacggcgccaattgagttttggatgaaggccaactgttcggcaatttcctcgtcgttcgtaacggcaatcccccccaccacgtcggagtgaccgcccaggtacttggtggcggagtgaactacaatgtcggcgcctagggtcagcgggcgttggttatacggcgtggcaaaggtgttatcaatgaccgtctttaagccatgcttcttggcgatcttagcaatcgcttcgatatctgaaacctccaagagcgggttggtgggtgtttcaaagtaaatggccaccgtgttgtcctgcacggccgcttcgaccgccgctaggtcctgggtgtcgacaaccgtaaattcgaggccgaaacgcttcaggaccttgttgatcaaacggaaggtccccccgtagacgtccttaccaacgatgaagtgatcgccggaggagtagagggaaaagacggcgtggatggcagccgatcccgaggcaaaggcgaagccagcgaccccttcttctagttgggccattaagagttccaaggaggcacgggtcgggttgccggtccgggcatattcccacttggtgccaccgccgaggacgtgttgacggaaggttgaggagcggtaaattggggtcgaaaccgccccggtggttgggtcttcgctaatgccgccgtgaattaattgggtattaaacttcataatgtttctcctttattcgtaaatgttttcgcttaagtaacgttcgctagagtcggggaaaatggtgacgatattggcgccggcgggtagtttttcggcgaccttcaaactggcggccagggccgaaccagaggaagagccgatcaaaagccccagctccctagccgcccgtttaacccagccaaaggcatcgtcatcggtaatcgtttggaccttgtcgatctttaaaccgctaaagaagggtggcacctgttcaaccccaatcccctcggtacggtggtcgcccttgggttggtgatcgagaatggatcccttgggctgaaccgcaaccgtgtaagcgttcgggtagacgtttaagagcgccttagcggttccggcaaaggtgcccccggtgccggccccggccacaaaggcgtcgattggttgcccgtttaagtcactgataatttccgggcccagcgtccgttcgtaggcccgtgggttatcgaagttagcgaactggttaggcacgtaggaatcggcaatgctggcggccagctccaaggcctttgcggtggccccggtcattccgccctcgtccggcgtgttaattacctccgcgccgagcgccttcataagtgtctgcttttcaaagctaaagtgctccggaactaccagaattgtcttgaggcggtgcttagcggcagccagggcgaccccgatcccggtgttaccggcggtcggttcaatgatcgtggtcgtgttcgtgatcgccccgcgggaaatcccgtcttcaatcagggccatccccaggcggtctttgatcgagccccccgggttatacatttctaacttggcaaagacgtggctgccgttggggacgtcaagcggcaactccaagagcggggtgtggccgattaattggtaaacattgtgaactagcatcttggttactccttttctaactgaggatacaaaaaaggcgccgattcaagctgaatcagcgccaattacacttactccggattaagcttatccccgtttgagggaacgccaaagagtggagccgcgtaattgacgcgctccacaacaacatacggcttgcttagtaaatacgttagtcattggtgttccctcctttcaaagtgctttaactataaccggttactttttgtatgtcaataagggatttaaaaaagtaacccgaacgtctggaagaacaattgcatttccgttcggaagcccgtatgattagagcaaattataaccattgaggtgatcttcatgaaagcaattgttactaccgttggtcaagaccaagtcggcatcatcgccggggtcagccactacctttccaccgctcagattaatatcctcgacgtttcgcaaacgatcatgagcggctactttaccatgatgatgatggttgaagtcccggctgaccaggacttcactaagctagccgccgacttaaaggacctgggcacccagcttggcgtggagattaacatccgcaacgaacggctctaccaagccatgcaccaactttaggagggcgccatggaaatcgaaaagatccaagaaacgattcggatgatcgccgacgaaaacctcgacgtccgaacaatcacgatggggatttccctgctcgattgtatcgatagcgacagcgaccgggcctgccaaaagatctacgacaagatcacgactaaggcccaggacctggttaaagtcgggcgccagattgaagccgaatttggcctgccaatcgttaacaagcgggtcaccgttaccccaatcgctttaattgccgccgccagtggtgacgccgattacgttaagtacgctaagaccctcgaccgggccgcgcacgccgtggggatcgactttatcggcggtttctcggccctcacccaaaagggctaccagagcggcgatcgcgttttaattaactcccttccccaagccctggccgaaaccgagttggtctgcgcctcggtcaacgttggttccacccgcagcggaattaacatggacgccgtcaaggacatgggaacggtgatcaaaagggccagtgagttggacctgatggccaacgccaaactggtggtcttttgtaacgccgtcgaggataacccctttatggccgggggcttccacggggtcagcgaaccagacgtcgtcatcaacgccggggtttccggtcccggggtcgttaaggcggccttggaaaaggtcaaggggcaacccatggacgtggtcgccgaaacgatcaagcaaaccgcctttaaggtcacccggatgggacagctagtcggcacgattgcggcccaacgcctgggggttcccttcggcatcgtggacctctcgctggccccaacgccggcgattggcgactcggtggcccagatcctagaggaaattggcttggaacaagtcggcacccacgggaccaccgctgccttagccatgctcaacgacgccgttaaaaagggcgggatcatggcctgcagccacgtcggcggtttgtcgggagccttcattccggtctcagaggacgccgggatgattgacgcggtcaacgcccacaccttaagcctcgataagctcgaagcaatgacggcggtctgctcggtgggcctggacatgatcgccatcccgggggacaccccagccgaaacgatcagcgccatgattgccgatgaggccgccatcgggatgattaacaacaagacgaccgccgtgcgggtcatcccggtcgccggcaagcaggttggcgagacggtcgagttcggtggtttactgggccacgccccgattatgggcgtcaataaggcctcgtctgccgccatgattcaccgtggtggccaactccccgcccccgtccacagctttaaaaactaagcacaagagcctaggagaagagccgcttttctctcaggctcttgttgtatcccgaatgttagacagaaaacgtggcaaataaccgcaagcctgctagtgtctaagccgtctgaagaacggtacgtaccctaccaaccgctcaccctagctaagtcagacgacctgccgagaaagttattttccacccacttaatcggcatactgattcagcagggtgcgcaatttttttaaataaccgtcaattagcggttggggctctataagcttggcgtggttgctaaaggttaagaggtagtcgacgacgtaatcgaaggtccgctcgttataatagccagtcaagtagtagcggccggcgttttcttccagtcgcatgctggggtaattactccgcaagaagtggtcccgaccatgctctgttaacaacgccttgaacttgaccccaccctcgccgtgattaaagagcttaatttttgcttggagctcttgtttggttagtgctaggggcgaggctagctcttggcaactagtcaggcagtcgcaccggtagttccagcaagtttgactggtcgggtcccagctagccaccaaccaatagccgtcccggtaaaggagctgatagggctggatggtcagagcctgaccgttaaaggtgacgctggctaagtgattgtgtgagataatcgtcaataggttccgcaagtacgggttatgtttgaccgcagggacggtgtagtaggcgaccgcatcttctagccgccgaacccccgcttggcgattaggggctaaattcatgaggagcttggccctaatttgtttaaaaggttcgttaaagggcgtttcgctcatcattgacatcgctttgagggcgaagaagatggcgtggatttcatcagggttaaagtagaccttcgttaacaacccctcttgaattaggtggtagccgccagccggaccaggcgttgaataaagggcgagacctaactgttctaggctttcaatgtcgcggagggcagtccgcttagagattttgaaggtggtcattaggtcgcttaagtgaaaggagtgcttatcgctgaggtaaatcaattcttggttgaggcgggcggatttttgcaagttcatttcccctttttgcaatggtgacaagatctgacaccattatacgataaagtaagtacatcaaaaagaatgggggcattttaatgcttgaaaaaagtaccacccttaccaagggcctattagaaatcatgccagatccgcagccagtcaccatcgtctccgtcgaaggtaatccggcgcacgtcgttaacacctggagcgactacgttcaggttattgatgaccaaaccttcttaattccggccgccgggatgcggtcaattgaagccgacgtccagaaaaagtccagtccgttaacgatcgcctttggctccaagaagtttgcaggaaccgaagggatggggcggggctaccacgtccacgcaaccggggagttcttagccagcggcgaatacttcgaccagatgaaggctaacttcccttggctgcggaaagtcctggtcgtgcacgtaaccgacgtagaacaaaaaatctgaccataaataactaaagaggctgagagaaaacacagttttctcccagcctcttgttgtgttcacgaatgttagtcagataacgtgctcccaaccacgggcctagtggctaagtctggccacagaacaccgccgagggcgttaacctgtaccctatccttagccctacggcccgtcgaggaggttagaccgcactcactttgaaaacgtggtcaatcccgtggctattcccccgtaatcccgtgtttggttgaggccaagtactgatcccagacccgttggatggttacccggccgttggtggcggcgacggtgaaatcccaggttgccatcaactcatcaatcagggcgttgcgctggtcaaccgaaagccccctgacggccccgaagcgttcctgggcccgctcggtcagccaatacatcatcccgctacggcgaatcgtccggtagctcattagctcctgatcgccgtagaaatcagccgctagctggcgcagcttatggttaatcgcccaccgcttgatcgtttggttttgtacccgccggcagccgtgaattaaatagcagccgaccttatcctcgttttcccccacgagttactttagcagttcctcttcccggtcggacaggcgtaagctccggacgccgtggcgggtcgtaatccgcaggcggtggtcgcccaagtcacggttttgaatgtagcgcaagccgtagtcaattccgcccccttaaaaattagcagggcgataatctggggcaagatcgagccgtgcttaccttcagtcaggcaaaccgtcgacagtttgggcgaaaccaggtcctcataggaggtgaagaaaatgtcgttggactgggcggttttcttgagggcccgttcaaagagttgccagtggtttttcacccggcagtgggtatggagtcggcaaaagtcacaaaagtcaatcaaattatcctggtggcgccggatcatcaccggggtcaagccggaactaacgatttggtggaccacttccttggtgttagcgatcgtgaattgaagcagggagcgcccaaactggtcctcgtacttttgcaagaggttgagcgtcccccgcaccaccaccgcccgcaggcagttgtggtcccggtgacaaagccaccgtaagtagagggttttagcgttatactggaagtgaaacgggggtgtaaaggtggggacaccgggccgatcgtcatcaagcagggtcagcttcagtgaccgttccagtaactcctctttgggcgccaccatgaatagtcgctccaccaggtcctcccccaaagtggttaacgggccatcacccagcaatgattttatcgatcgatcacttatcatgtcgtggcgaactaattgtctttgagtctgttgccaagccggcagtagcttaattttcagtgtactgttcttcattctgacttcacccttatcgcaaataatttctctcatcgggaaatagttcgttttttagtatgcgctgtcaaaacaacaaagtcaaccggtcgataaaggggcgataattggaatgaagagctagtttgcgtcagttaatttaataaaattgcttttgtgtgcggcgaattgtcaaactaagtgcaacggtttgtcaaaaaatacttcatatggggtttcatagtttaacactttgcgaggacgttgatttaactgcttttggcagtgttcaacgtcctgttctgtataattatcaatatctgttcgcttgggaaaatattcccggattaatccatttgtattctcatttgttccacgctgttcaggcgaatatggatcgggccaatagacagtaatacctaacctttcgctgatttcatcaagatgaagaaattcggtcccatgatctggtgtaatagaatgaacaaattctttaggaatggcccctaacagttcaactaagcctttatttatctcctgcgagtccttttgcataacctttttgataagcgtaagccgactaagccgatcgacaaccgttaaaaggatggagtgacccgttcgaccaatcacagtatcaatttcccagtcacctatacgttgacgctggttgataaaaccagggcgctcatggatcgagatatagtcggtctgtacttctcgatgtcgtctagtattctttgaatgccgggtccgatgtttatgtctgagatggcgctgaataccggtatcaccacgtgaggagtacttttcacctaaattgtgttgatagatatgacggtaaattgtgttgtagctaacacaccattgatgttccttattaaagcgagcggtaatctgctctggtgaccagtgcagatctaagatgtaatgaacaatttgacggcgtaattgtggatggctgtctaatagccgcttcttgtgacaattctgccgcttttgatgatagtcattatctgctttgcttggggaataattacctgcacaacgttttaactcccgtgaaatagtgcttggatttcgccccagccgtaacgcgacagcccggatagataaccccttagctcgtaaaaacataagtatttcacgttcttttatagtaagatgtttatagctcataccggatacctcgaattgtttaatttggtcgttaaacatattctacccggtatgggtttatttttttactttgtgttgcatttcaattgtaaattcgccgcacaaaaaaaagaacgccccttcggacgtccctggttagttggtcagctgttgctggcggatttggatccattcttcaaattgacgaaggtcctgttcatttgccgatttaaggataaggttcttcccccgactcttgtattgaatccgacgaacaacatctgggttcttcttttggtagcgcacgttggcacgcttttgggcttcgcttatcgacatgtaaattcaccgccagtctatatgtaatcgtacatgataattatcggtgtgaagatcaagattcccaatccactaaatcaaagtggataaaaatacggtcaaagggtgaattatcagtagtatatgaggagacttgaataaccttcatcccgacccctttgactatatttattttacacccgatagacaagatagatcgaatagattttcaaataagaaaaatacgtttatttataagcacacaaaaaccggctttccccgccgttgccgggtaaaaagtcggttgagtaacgaaaattttgattttattttacgccttgtttaacaagtgacctgtcactcgttcgataacggtggcggggttttcaacactcaaaatcaaccggtcgtagccttcgtttatcagcgttataacaacgatcggggtattacggcgtacgttatagaagcggcgttgaccgtcataaaaaaagctaccggcgtagtataaaccaggaattgcggttccgggcaagcgcaaacctttgtgctcctcaaaggccccctgatcacgaaagataccggtcacgtgcctccaaggcacccgaatggctcccttcagcgcccagaggcggtcgagaccggccggggaaacgaccagttcggttggcgtaatggtaatttggttgtacattgagcatctctccttatcgatcactacttaaatggactaatgtaagggcaactttcattatcaaaggttatggttagtgcttggcaaggtgcaaaagatccaagattcgtttgagtggcagcgactgaatcagggtgcacaggatgatcaataatgaacccaagacgctcgccgccgtcaacttggttcccaagaaagccaccgctaaggttgtggcgaccaatggttcaaaggccgacaacatcccggtgacggctggtgaaatgtaattaatgctgctcaaaaagagggtgtaggccaggatcgttccgaatataacgatgtagacaagggtttcccaatcgaaggccgtcatattgggtaagggcgtaaggaccaaaactgggctcatgcaaatccccccgatcagcattcctaggccgcagacggttagcgtgtcgtagcgacttaacaggccctggggtaagacggtgtagatggcggccgccagcgcacacattaacccccaaaacagggcgatcggcgtcagggatagcgagttcaagtgtccgccggtgaccaaaaagaaggtccccaccagagcaattgtaatcgaaagtatgtctagccgcctgggccaggcccggttacgaagggtaaaccagacaatgattaacaccggttgtaagtactgaatcaccgtggcggtcggggcgttgctcgtttgtaccgccttcatataggtaaactgggagttcagcatccccaaaaaggtaaatgcaattaaaatccctaggtcgcccctattagttaagagccccttgatttgccccgggttgcgcaccaaaccgattgccgtcatgattaagccggcaaagatcaggcggacggccactaaccaggatgcggtcattgacgtgtgtgaaaagattagctgggcgccagctcccgaggccccccacagggacgctccgcaaatggccaggaggatccccttgtttgattttgtcattcaatcccctctcttcttctaaagtgttaaccctaaatatagcagtcgccaaaagaaatgaacaacccccctcgccaaataaaataggggtggaagcggtttatcaaaccctttataatatagatagaaaatctagatcgaagaatgcggggtccgttaaccaatgggggttggttaaatgggtgcacccctacgtccaattactgatcgacgttaaaagctgctattcgggaggaagcctcatggcaagaaaaattaaggatgataacggtcacgtgtacgtagaaaagaagcccttttataaacgggtctggttctggttagtggtcgtggtgttagtggtgattgtcgccgcggggatgggtggctccggttcatcggatagctcagataagtccgcctcgagctcgagcagttcggccaccccactcgataaggtgtacaaggtcggccaaaccgcctcgtataagggttataagattaaggtcaatagcgtttcgtacagttccggtaacgagtacgaacagcccgattccggtaagcaatacgtgattgtcaacgtgacgatcaccaacgataccgacgaatcgcaagactacaacccttatgactttaagctcaacgccgacgggaataacaccgacctcgatgaaatctacaccgacgtcgacaacaccttaaacgccggttccttagacaagggggcctcggtgaccggtaacatggtcggccaggcaagcacgagcgtctctaagctccagctccaataccagacctcggtttggaacaataagacggttaagtttgatttgaagagtaatcagtagaaaaaagatcccgggaataacgactttcccaggatcttttttatttcggttttttacgacagggagctttagagactgcacaaatgtttagatttgtcctgtccccctagccgttttcttgtgcggcggtatcggcggccaagcggccaaaggtaaagatatcagccaacgagttaccaccgagccggttcccagcgtggaggcccccggcgttttccccggcggagtataaaccggcgattacttgctccgccttgtctagcacgtgaccgtgttcatcaatcgccaagccccccatcgtgtggtggatggccggcttgcgcggggtggcgtaaaatggcgccacttcgcacttaaggtggaaggcactcttgccaaactccggatcgtggcccgcgtcgacgtaagaattgtacttgttaatcgtgtcttccagggtggccgggtccatccccaccttcccggctagttccgctaacgtatccgccttaaagagggtgccggcttcgacttgggcgtcaattgattcctgggtcgtgttgtaggccgtctctttgatcttatcatcggcaatcaagtagaagaggcccccctgggcaatcgcggcggcggccagggtgtcgcgttccgcaaactcgttgacgaaccgcttgccctcttggttgaccatgatgaagttttccggtggcgtctgcaggccggtaaacagttccccggtcaccgggtcggagactggcattaactggataaagcccatcccggtcaactcggcgcctgcctcctggcctaaactaatcccgtcaccggtgatggccggtgaattagtggtggcgatgtcgtcgtcaatgtgctcccagtaggtgttgtacttttggaccattggcgtgttggcgccaaagcccccggcggtcaagaaggtggatttagcacggacggtcaccttagtcccgtcggtcttgtgggccacgacccccactacccggccgttttccatcaggaggtgttcggcacgggtttcggttaggatggtggcaccgtgttccgtaacccagtcgcccaggacgtgaatgaaggcgtaccccattggctcaaccggcttgtggccacgccgccacagggccccaaccggcattgttacgtcggtttgatcgaatttaaccccaaggtcagctagccatttgaccgagtccagagcgttatcgaccaaggtcttgaccagctggtaccgaccgtgaatttcatgaccggcgaggtcttcacgcttcccccctaggtaagtctggatttcgtgaaggaggttggaatcaaagaggtactgggctccggaagcaatgtattccttaatttgctcccgtaaccgttcaaagtcggcacggtattcggggtcgatctgttctaatggcatgttagccaactgtttcagggtctctttttccccggtcaaggcggcaaagtccctttgccagtccggatcagcggcgttcattggtcccccggcccgggtggtgttgccccctagttgcgggaacttttctaaaataacaacttgcttatcgtgctggaggctccgggtagcggccgccaagccagccccaccggccccaactaccaccacgtcggtttgatattcctcaacttgagcggcctgagtcgctgcttctggcttggcccgttgcttccactcagcggcatcgccaccggccagggtaatcgcttcggccaccccgtcaacgaccccacgtgaggagattgtcgccccggcaacggtgtccacgtttagcgtttgtcccttcacaatcttagccggaagccgtttaaaaacttcgtcggcgatcccgcttgtttccccactggcgtcaactcgaatccgttgaatcgcatcgtcgcttagcgtgacctccattggcatgaaggatgagccgtgccccttagcttttactttgtacgttcctgctttcattgttcatcgctcccttgtgaaatcaatctcatgttcgagtaaattgtagcgcttccgaacggaaatgggaacgacctgtgttattattggatcataactaaaatattatcgaaaggatggttaacgtgcgtgacccggatttgatgctcaactacttagaggtcttgcttaagcacagcaacttcactaaggcggctagcgagctttacatctcccagccctatttgacccagctaatcaaacggatcgaaaaggaattgggcgccccaattatcaaccgccaccgcttacccttctctttaacggaagccggccaaatatactaccagtacctcgagaacctgtcagccgaacatcaacgccttgcacttcaattagcccgctacaccaacgacagcaccaaaatcatccgggtggccgttttagagagcctgggaaccttcttgttgccggcaatcctcccccgcttcttaaaggaccaccccagcgtccggatccaagtggtcgaaggcttcccccaccaaagcgaggagcggattttaaatgaccaggccgacctttacatgggccaaacccccgaaaccttaaattacgggattcacccctacattaacggcggcgagaactactacgtcatcatccccgccacctccaagttttaccaacccggtcgcttcatcctcgacccttcaacgtacaacctagacgacctcttgcaagaacccttcgtcttgagttctgccgaatcggaaattcgccaccaggttaacagcctctttcaaaaccggaagctggttcccaaggtagtgatggtctcaaacagcgtcatcacggtcgccaacctcgccattcagggggtgggcttgacgatttcggccgccagcatcctcaaacggattaaggaaacgccgatcaacctctacccactcgacccctcgctgatccaaatccgctactttattggcgccaaaaaggaccgtccgctcaccgacgccatgcgagacctcattgccgcttttcagtccgccaacctccaaatgaaaatccattgatgaaggcgcttttaggcaaaattagggttttcgtcacttatgttggcaatccggtggtgctataatttctgtatctagtcgacaggagggaatttcatgttatataacgcagccttagttttagaaggtggggcgatgcgcggtcaatactccaccggtgttaccgatacctttttaaaacaccacgttgaattcaaatcggtaattggggtctccgccggggccctgtgcggggcgaacttcgtttctaagcagtacggacgaatggctgacgttaacacccactaccgtcacgaccgcaattacatctcccccctgcgccttttaaagcgcgaggaaattttgaacttagactttttgtttgaagaccacggctgggactggcacaacttcgacgaacgggcctaccagcgttcggcgtccgatttcaccatcgtcgccaccgctctagaaaccgggaaggccgtcaccttcacaaacgcgacgggcgaagagttcatcaccgacctgaaggcctcttcttcgatgcccttcgtttccgagccccaggtaaccaccgccggtccctgtttagatgggggcgttgccgattcaatccccttcgacatcgcccaagagcaggactttgacaagatcgtggtggtccggacccggccgcgtgactaccgcaagaagccgaccagccgggtgcttagtgagatgtaccagcactcctttaaggactacccggccttcgtggatgccgggattaaccggccaaccgtctacaaccagcaggtcgaaacgctcgatcaacttgaaaaagaccggcaagccttcgtgatcgccccgacagaaccaattaaggtcaagcgtctagagggcaacgttaaaaaaattcgccagctctacgaacagggccaggcccaagccgaggaaatcttagccgacgttctcaactacctggagaactaattgatggcggcggagtgatcaaagtggtcactccccgcttttttcgttaaaatagatgagactgttaatattaaacaaatgagggttgataagtatggaaaaagttgttttcgttggagctgcacggacgccgattggaaagctcggtggcgccctggccacactgaccgctgcccagttgggaacaattgccatccaggccgccttagagcgggccgcggttgctcccgaagaagtgaatgaggtctacctgggctgcgccatccaggccggccaggggcaaaacgtcgcccgccaggccagcattgccgccgggttgccggttaccgttccggccaccaccgttaacgtgatgtgtggctccggaatgcacgccgttaacctagcggccaagctgattgccatgggggacgccgaagtgatggtggcggggggcaccgaaagcatgtcgacggccccgtatttgatgcccaagggccgctttggttacaagtacggtaacgccgaactggtcgacgccctgtataaggacgggttggaagacgccttcttccactacccaatgggttgcacggccgaaaacctggtcgaaaaataccaggtgactagagaagacctcgaccacttcgccctgcaaagccaagtgcgggcacggacggcgcaagacgcggggcgttttaaagacgaaatcgtgccggtgaccgtcaagggcaagcgccaccaacttgaagttacagaagacgaggcgattcgcgacacgacgatggaaaaattagcggccttaaagccggtctttaaagaaggtggcgacgtgacggccggcaattcttccggattaaatgacggcgccgctgctttaatcctaatgagcgaacgccgggctctggcggaaggcaaggaaattctcggctactggcaggccggcaccttggccggggtcaagccggaactgatggggatcggccccttggcggccaccaagaagctgctcgcccaggttgacatgacgcccgaccagcttgacctgatcgaaattaacgaagcctttgccgcccaagcgatcgtttgccagcgcgaattgggcttcgaggagagcaaggtgaacgtcaacggtggggcaattgcccttggtcatcccctgggcgactccggggcccgcattttggtgaccctactctaccaaatgaagcgccaaaacgccaagcgggggctggggaccctgtgcattggcggcgggatgggcgctgccaccctcgtctaccgttaggaggattgtatgcgtaaattattcaaactcccttatgcccccttagtggtggctattttcgccttatacctggcgattacctattggccaaacgttgcgggcctgttgaaaacattattggcggcagccatgcccctcttgattggttgcgtgattgcctacatcgttaacctgttgatggtacgctacgaaggtttataccaccgggtctttaagggacagcgggcccaaaggtttgcccgggtcaccgccctttgcctcgcctacttatcaatcgtggtggtgattggggtggtttctagcgtggtggccccccagttagtagcttgtgttaagttgctcttctccgggcaaagcaaggtcatcccccagttcatcaactggctagaaaacgagagctttttaaagagcctctggcaacaaattgacctctccaagattaattggactaaggtgcaaagttacctcttaaacggggccagtggcacctttagcacggtcatgtccaccgctagcaaggtggtctccgccctgactacgaccgtcgtagcgattttcttttcgatctacctcttgctctttaaagaccgtctcgcccgccagttcaagctcttattgaccacctacttgccggggcaagtggcccggattttacgggtactgacggtgtttgaccagtccttttctagctatatcgtggggcaagttaaagacgccgtggtgctcgggtgttcgtgcaccgtcttgatgctaattctccaactcccttacgcaccaatggtcggcgcggtgatggccgtcaccgccctcgtaccgatcatcggggctttgatgggggccagcgtggggatcatcgtgatcttcgcagtttccccggtcaaggccctgatcttcttggtgatgattctagccctccaggaattcgataaccgggttacttacccgttgatcgtcggcaagtcgattggcctgcccagcgtgtgggtcttcgtggccgtcatggtcggtggcggggtttccgggatcctagggatgatgttcaccgtgcccctctttgcggccttctaccaactattaaaaaccgacgttgccaagcggcaattaaactaaactcacccccaccctagtgcgccaaggtgggggtgatagtgtataataagcgtgtttttagttaaaggaggcggcagatttgacgttaaatttgttggtagtggtgtgtggttttctgattggctttttcgttatctcaaccgggggtggcggggccgctttgtaccttggggttttaacggggctgtgcgggttaagtgccgcccacgcggtggatacctcgcttctaaccgccatccccgccctgtgctttggtgccctgtccttttaccgtcacggcaacgtcaacgtcaaactagcccgccagtttctgtacttcgccttaccaaccgtgatcgtagcttccttgttggcccgctacattcccgaaaagatttacgccccgctgattggactcgtcttggtggtgttaggggttcaaatgtactttcgcaaggtgcgccaaacggaagatatccacgtcgaccgggtcaaggcagcctattacgccatcttgtccggtttaatgatcggcatcggtgggctttccggtggcggcgtgatcgtggccggcctgctagcgataggcgaagatatgttgggcaccgtggccacgtctagcttcatcctcgtttggacgagtttaatcggtgccgtgatgcacataactggcgggggcgttagctacttttacgccctgttactgataatcggctccgtaaccggggcgcttatagccccacgggtcttatcccgggttaaccgggcaacctttgaccggatttgcaagccagttatttccttaattgtgatcctgatggggttacagatgattttctaactcaactgaagaggccggggaaaattccgttttcccccggcctcttgctgtattcacgaatgttagacagatagcgtggaaaataaccgcaggtctagtgtctaagcaggccgaagaacagtgcgtaccgcactaaccgttcgtcctagcttagtcatatgacctgccgagaaggttattccccaatcactttcctatgcgtacttgtgggctaacttaccgcacagggcggcgacaatcgcccctaacaaatcatcgatgaaggtgttgacctggtcgttatcctcatcgtattgcttgatgatcccgtacttgacccggtcgagataaccgaagttggttaccccaatcgtgccgtagatgttggcggtttgcagggccagggcttcatcaaccccgaagacgccggagtcgtttctaatgatggtcaataagggctctttaatttgcccctcttcggccaggcggtcgagttccaacgccaccatcgcgttgttcaagagttcgcgtttgtgcaacacgttcagcagttcttggtagcactcctcctgggtaatggtgggcacgaagttgtgctgtaaatcataggcgatcccactcaactggtggaggtccaccccgcgctttttcagtccgtcaataacgaagtcaaaggcagcggtgtcgggatacttaaagtctttatttaacatgctacatcctccttaatcgagttcctaagccagtttgctgtagtaatagccggttcagttgcgtccgaatcgtttttgcggtccctaggttgatgttattagtgaaaaagatcatccgctgctgggtcgaaaagtcccccgaggcaatcgccgagtaaccagcgtagcctccgttggtgtgaaaactattaccgctaaagtaaatcccgccaaagtagctaaccgtcttttggtcggcgtacttatggagccaggtgctggctgcctggtcgtccatcaagtggctaatcaattgccaataacctaccggggtcgccaagtagttcccggccccaaaggtcgccgacatcgcccgccgcaagctcgtccaagaggccgttggcaaaaggctcttagacacctggctggccttcagcgcactaaagggtttaatctccttaatcccccacggcgccaggattttgtcccgaacgaactgatcatagctttcgccgctgaccttggaaacgatcgcggctaagaggacgtaatcgatgttggagtagttccaagtttctttaccactcgacttatagtgggccaaggagtatttgacctgttcgctttgactcatgaggacccgtggagcgaccgtctgggtgtcggcaagccccgaggtgtggctcatcagccacccaatcgtaatttccttcgcgtgggccacttgggggtagtaagtcgccagggtggtgttaaccgataatttgcccctccttgacgagggtgtagatggctaatcccgtcaacagtttttgcagcgacgcagtcgggaagtaacggtggctagagaccgcccgttgactgttggccccccaccagtgagttttgaatcacggtgggtgtgtcatcgctaccaattaaaagaatcccgttgacgtggttggatttaagcacgtccttgagcgttaattgaagtcgcttggtggttgaaattacttccggggcgtgtacaatccgggggcgaaccccagtgatcccgattcccgcaagtaagccaagagccgtgccgaatagccatcttctcttcaaagatcgtcacccttccaatttttcgcggcgtcttctttattcagttgcgccagctggtcgatcatcgtcaggcgttcgcgaggcgagaggttacgtaagaattcgaaaaaggagtccggaaacttcttcattaggtcaatgaattcctgggtggtcttatccggttgggcaatcatgtccttgtagcccaggtttagatcgatgttggattcccccaccggttggcgatcaccacttggaccgcccgcatgaggacgtggctatccttaatcgaaagtatttcggtggtctgcatgtacataatcaagtagcgtaacgctaataaaattggctccggatcggcgtcgtctggggcgaaggcctcccactggaggaggaagtcggtgggcgatgttaggtcatcaatgacacacatcggccaccgctgggttaagtagtcgtttaggtattgatcgagcaattccttgatctgaacccgggtcttttcatccgttgtggtgtaggtttccacccaggtcatcaggtcagcgattagttcggtgttaatgtcgatcaattggtcgtacaccgcttggacttccggggcctgctcgtcaaagttagctaagtaggttggggagttgtttaagtccacccaacgccgtacaaagtaattccccttgttcgtgatcatcgggatccggacctggttgacgatttgatcggtaaagttgatcatcggcgtttcctggcggccaaaccgttcccggtccgcgagggtgaccgattccatcgctaaccccattaacaggtcgttttcctcgtagctttctagttcttccggggtgatcttgctaaaggcgtccacgtagtaacggaaggcccgctctaacaagaagtcattgctcgtgttccggt

SEQ ID NO: 3 - DNA, 34 bp, Artificial Sequence
  Description of Artificial Sequence: Synthetic forward primer
cagggacccggttttggtaaagatggtcggattg

SEQ ID NO: 4 - DNA, 45 bp, Artificial Sequence
  Description of Artificial Sequence: Synthetic reverse primer
cgaggagaagcccggttaattgtcttcaatattagcataataatc

SEQ ID NO: 5 - protein, 11 aa, Lactobacillus fermentum
  CNCM I-5068
  Figure 2
GFRIDAADDMD

SEQ ID NO: 6 - protein, 11 aa, Lactobacillus fermentum
  CNCM I-5068
  Figure 2
HLSYNEGYGPG

SEQ ID NO: 7 - protein, 14 aa, Lactobacillus fermentum
  CNCM I-5068
  Figure 2
YVTNHDIRNNLING

SEQ ID NO: 8 - protein, 7 aa, Lactobacillus fermentum
  CNCM I-5068
  Figure 2
EDIVMNQ

SEQ ID NO: 9 - protein, 11 aa, Lactobacillus reuteri
  121 (GTFB)
GFRVDAADNID

SEQ ID NO: 10 - protein, 11 aa, Lactobacillus reuteri
  121 (GTFB)
HLSYNEGYHSG

SEQ ID NO: 11 - protein, 14 aa, Lactobacillus reuteri
  121 (GTFB)
FVTNHDQRKNLINR

SEQ ID NO: 12 - protein, 7 aa, Lactobacillus reuteri
  121 (GTFB)
EDIVMNQ

SEQ ID NO: 13 - protein, 11 aa, Lactobacillus reuteri
  ML1 (ML4)
GFRVDAADNID

SEQ ID NO: 14 - protein, 11 aa, Lactobacillus reuteri
  ML1 (ML4)
HLSYNEGYHSG

SEQ ID NO: 15 - protein, 14 aa, Lactobacillus reuteri
  ML1 (ML4)
FVTNHDQRKNLINR

SEQ ID NO: 16 - protein, 7 aa, Lactobacillus reuteri
  ML1 (ML4)
EDIVMNQ

SEQ ID NO: 17 - protein, 11 aa, Lactobacillus reuteri
  DSM 20016
GFRVDAADNID

SEQ ID NO: 18 - protein, 11 aa, Lactobacillus reuteri
  DSM 20016
HLVYNEGYHSG

SEQ ID NO: 19 - protein, 14 aa, Lactobacillus reuteri
  DSM 20016
FVTNHDQRKNVINQ

SEQ ID NO: 20 - protein, 7 aa, Lactobacillus reuteri
  DSM 20016
EDLVMNQ

SEQ ID NO: 21 - protein, 11 aa, Lactobacillus salivarius
  GJ-24
GFRIDAADHID

SEQ ID NO: 22 - protein, 11 aa, Lactobacillus salivarius
  GJ-24
HLSYNEGYRSG

SEQ ID NO: 23 - protein, 14 aa, Lactobacillus salivarius
  GJ-24
YVTNHDQRANLING

SEQ ID NO: 24 - protein, 7 aa, Lactobacillus salivarius
  GJ-24
VDIVMNQ

SEQ ID NO: 25 - protein, 11 aa, Pediococcus pentosaceus
GFRIDAADNID

SEQ ID NO: 26 - protein, 11 aa, Pediococcus pentosaceus
HLSYNEGYHSG

SEQ ID NO: 27 - protein, 14 aa, Pediococcus pentosaceus
FVTNHDQRKNLINS

SEQ ID NO: 28 - protein, 7 aa, Pediococcus pentosaceus
EDIVMNQ

SEQ ID NO: 29 - protein, 11 aa, Lactobacillus plantarum
GFRVDAADHID

SEQ ID NO: 30 - protein, 11 aa, Lactobacillus plantarum
HLVYNEGYNYG

SEQ ID NO: 31 - protein, 14 aa, Lactobacillus plantarum
FVTNHDQRNNLVNR

SEQ ID NO: 32 - protein, 7 aa, Lactobacillus plantarum
EDLVMNQ

SEQ ID NO: 33 - protein, 11 aa, Lactobacillus fermentum
  ATCC 14931
GFRIDAADNID

SEQ ID NO: 34 - protein, 11 aa, Lactobacillus fermentum
  ATCC 14931
HLIYNEGYHSG

SEQ ID NO: 35 - protein, 14 aa, Lactobacillus fermentum
  ATCC 14931
FVTNHDQRKNLINQ

SEQ ID NO: 36 - protein, 7 aa, Lactobacillus fermentum
  ATCC 14931
EDLVMNQ

SEQ ID NO: 37 - protein, 11 aa, Lactobacillus acidipiscis
  KCTC 13900
GFRNDAADNID

SEQ ID NO: 38 - protein, 11 aa, Lactobacillus acidipiscis
  KCTC 13900
HLVYNEGYHSG

SEQ ID NO: 39 - protein, 14 aa, Lactobacillus acidipiscis
  KCTC 13900
FVTNHDQRKNVINQ

SEQ ID NO: 40 - protein, 7 aa, Lactobacillus acidipiscis
  KCTC 13900
VDMVMNQ

SEQ ID NO: 41 - protein, 11 aa, Lactobacillus delbrueckii
GFRIDAADNID

SEQ ID NO: 42 - protein, 11 aa, Lactobacillus delbrueckii
HLSYNEGYHLG

SEQ ID NO: 43 - protein, 14 aa, Lactobacillus delbrueckii
FVTNHDQRKNLINR

SEQ ID NO: 44 - protein, 7 aa, Lactobacillus delbrueckii
EDIVMNQ

SEQ ID NO: 45 - protein, 11 aa, Lactobacillus panis
GFRVDAADNVD

SEQ ID NO: 46 - protein, 11 aa, Lactobacillus panis
HLVYNEGYHSD

SEQ ID NO: 47 - protein, 14 aa, Lactobacillus panis
FVTNHDQRKNLINQ

SEQ ID NO: 48 - protein, 7 aa, Lactobacillus panis
EDLVMNQ

SEQ ID NO: 49 - protein, 11 aa, Leuconostoc mesenteroides
GFRIDAADHID

SEQ ID NO: 50 - protein, 11 aa, Leuconostoc mesenteroides
HLIYNEGYRSG

SEQ ID NO: 51 - protein, 14 aa, Leuconostoc mesenteroides
FVTNHDQRANLING

SEQ ID NO: 52 - protein, 7 aa, Leuconostoc mesenteroides
EDIVMNQ

SEQ ID NO: 53 - protein, 11 aa, Exiguobacterium sibiricum
  255-15
GFRIDAASHYD

SEQ ID NO: 54 - protein, 11 aa, Exiguobacterium sibiricum
  255-15
HLSYIESYKSE

SEQ ID NO: 55 - protein, 14 aa, Exiguobacterium sibiricum
  255-15
FVNNHDQEKNRVNQ

SEQ ID NO: 56 - protein, 7 aa, Exiguobacterium sibiricum
  255-15
MDLVPNQ

SEQ ID NO: 57 - protein, 11 aa, Azotobacter chroococcum
GFRIDAASHIN

SEQ ID NO: 58 - protein, 11 aa, Azotobacter chroococcum
HLSYIESYVTQ

SEQ ID NO: 59 - protein, 14 aa, Azotobacter chroococcum
FVNNHDQEHNILVT

SEQ ID NO: 60 - protein, 7 aa, Azotobacter chroococcum
VDVVPNQ

SEQ ID NO: 61 - protein, 11 aa, Lactobacillus reuteri
  180 (Gtf180)
GIRVDAVDNVD

SEQ ID NO: 62 - protein, 11 aa, Lactobacillus reuteri
  180 (Gtf180)
HINILEDWGWD

SEQ ID NO: 63 - protein, 15 aa, Lactobacillus reuteri
  180 (Gtf180)
FVRAHDSNAQDQIRQ

SEQ ID NO: 64 - protein, 7 aa, Lactobacillus reuteri
  180 (Gtf180)
ADWVPDQ

SEQ ID NO: 65 - protein, 11 aa, Lactobacillus reuteri
  121 (GtfA)
SVRVDAPDNID

SEQ ID NO: 66 - protein, 11 aa, Lactobacillus reuteri
  121 (GtfA)
HINILEDWNHA

SEQ ID NO: 67 - protein, 15 aa, Lactobacillus reuteri
  121 (GtfA)
FVRAHDNNSQDQIQN

SEQ ID NO: 68 - protein, 7 aa, Lactobacillus reuteri
  121 (GtfA)
ADWVPDQ

SEQ ID NO: 69 - protein, 11 aa, Streptococcus mutans
  SI (GtfSI)
SIRVDAVDNVD

SEQ ID NO: 70 - protein, 11 aa, Streptococcus mutans
HLSILEAWSYN

SEQ ID NO: 71 - protein, 15 aa, Streptococcus mutans
FIRAHDSEVQDLIRD

SEQ ID NO: 72 - protein, 7 aa, Streptococcus mutans
ADWVPDQ

SEQ ID NO: 73 - protein, 11 aa, Leuconostoc mesenteroides
  NRRL-1355
GIRVDAVDNVD

SEQ ID NO: 74 - protein, 11 aa, Leuconostoc mesenteroides
  NRRL-1355
HLSILEDWNGK

SEQ ID NO: 75 - protein, 15 aa, Leuconostoc mesenteroides
  NRRL-1355
FVRAHDYDAQDPIRK

SEQ ID NO: 76 - protein, 7 aa, Leuconostoc mesenteroides
  NRRL-1355
ADWVPDQ

SEQ ID NO: 77 - protein, 11 aa, Leuconostoc citreum
  NRRL B-1299
SIRIDAVDFIH

SEQ ID NO: 78 - protein, 11 aa, Leuconostoc citreum
  NRRL B-1299
HISLVEAGLDA

SEQ ID NO: 79 - protein, 15 aa, Leuconostoc citreum
  NRRL B-1299
IIHAHDKGVQEKVGA

SEQ ID NO: 80 - protein, 7 aa, Leuconostoc citreum
  NRRL B-1299
ADVVDNQ

SEQ ID NO: 81 - protein, 11 aa, Leuconostoc citreum
  NRRL B-742
SMRIDAISFVD

SEQ ID NO: 82 - protein, 11 aa, Leuconostoc citreum
  NRRL B-742
HISIVEAPKGE

SEQ ID NO: 83 - protein, 15 aa, Leuconostoc citreum
  NRRL B-742
IVHAHDKDIQDTVIH

SEQ ID NO: 84 - protein, 7 aa, Leuconostoc citreum
  NRRL B-742
ADFVANQ

SEQ ID NO: 85 - protein, 6 aa, Artificial Sequence
  Description of Artificial Sequence: Synthetic 6xHis tag
HHHHHH

The invention claimed is:

1. A method of producing an α-glucan containing (α1-3) linked D-glucose units, the method comprising contacting a polysaccharide or oligosaccharide substrate comprising at its non-reducing end at least two (α1-4) linked D-glucose units with an α-glucanotransferase enzyme capable of cleaving (α1-4) glucosidic linkages and making new (α1-3) glucosidic linkages to form a glucose polymer having linear segments of (α1-4) linked D-glucose units interspersed with (α1 >3) glucosidic linkages, without forming consecutive (α1-3) glucosidic linkages, wherein the α-glucanotransferase comprises an amino acid sequence having at least 90% identity to SEQ ID NO:1.

2. The method according to claim 1 wherein the α-glucanotransferase comprises an amino acid sequence having at least 92% identity to SEQ ID NO:1.

3. The method according to claim 1 wherein the α-glucanotransferase is a Lactobacillus fermentum GTFB enzyme.

4. The method according to claim 1 wherein the substrate has a degree of polymerization of at least five.

5. The method according to claim 1 wherein the substrate is selected from the group consisting of starch, starch derivatives, malto-oligosaccharides, gluco-oligosaccharides, amylose, amylopectin, maltodextrins, (α1-4) glucans and combinations thereof.

6. The method according to claim 1 wherein the substrate is comprised within cereal flour.

7. The method according to claim 1 wherein the α-glucanotransferase comprises an amino acid sequence having at least 95% identity to SEQ ID NO:1.

8. The method according to claim 1 wherein the α-glucanotransferase comprises an amino acid sequence having at least 96% identity to SEQ ID NO:1.

9. The method according to claim 1 wherein the α-glucanotransferase comprises an amino acid sequence having at least 97% identity to SEQ ID NO:1.

10. The method according to claim 1 wherein the α-glucanotransferase comprises an amino acid sequence having at least 98% identity to SEQ ID NO:1.

11. The method according to claim 1 wherein the α-glucanotransferase comprises an amino acid sequence having at least 99% identity to SEQ ID NO:1.

* * * * *